United States Patent 12,790,634 (MOST PROBABLE NUMBER ANALYSIS OF HETEROGENOUS POPULATIONS) - sequence listing, part 33

SEQ ID NO: 26 - DNA, 3938040 bp, unidentified (residues 1-1,969,020 of 3,938,040)
  source 1..3938040: mol_type = genomic DNA; note = Clostridium_AP sp000509125
cagaaccttgataattgaacaatagacaacaaccctgaaaatttcttgtaaagagagaatttcagaacagaacgggacatcgagagatgtccgaccttaaaaacagtaataacgggaaagaattagccaagagttgattctgaccgcgatcacaacttttaacgagagtttgatcctggctcaggatgaacgctggcggcgtgcctaacacatgcaagtcgaacgaagcgcttccgctagattttcttcggagatgaaggcggctgcgactgagtggcggacgggtgagtaacgcgtgggcaacctgccttgcactgggggataacagccagaaatggctgctaataccgcataagaccgaagcgccgcatggcgcagcggccaaagccccggcggtgcaagatgggcccgcgtctgattaggtagttggcggggtaacggcccaccaagccgacgatcagtagccgacctgagagggtgaccggccacattgggactgagacacggcccagactcctacgggaggcagcagtggggaatattgcacaatgggggaaaccctgatgcagcgacgccgcgtgaaggatgaagtatttcggtatgtaaacttctatcagcagggaagaagatgacggtacctgactaagaagccccggctaactacgtgccagcagccgcggtaatacgtagggggcaagcgttatccggatttactgggtgtaaagggagcgtagacggcgatgcaagccagatgtgaaagcccggggctcaaccccgggactgcatttggaactgcgtggctggagtgtcggagaggcaggcggaattcctagtgtagcggtgaaatgcgtagatattaggaggaacaccagtggcgaaggcggcctgctggacgatgactgacgttgaggctcgaaagcgtggggagcaaacaggattagataccctggtagtccacgccgtaaacgatgactactaggtgtcgggtggcaaggccattcggtgccgcagcaaacgcaataagtagtccacctggggagtacgttcgcaagaatgaaactcaaaggaattgacggggacccgcacaagcggtggagcatgtggtttaattcgaagcaacgcgaagaaccttacctgatcttgacatcccgatgccaaagcgcgtaacgcgctctttcttcggaacatcggtgacaggtggtgcatggttgtcgtcagctcgtgtcgtgagatgttgggttaagtcccgcaacgagcgcaacccctatcttcagtagccagcattccggatgggcactctggagagactgccagggacaacctggaggaaggtggggatgacgtcaaatcatcatgccccttatgaccagggctacacacgtgctacaatggcgtaaacaaagggaggcgaacccgcgagggtgggcaaatcccaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagtcagtaacgcccgaagccggtgacccaacccgtatgggagggagccgtcgaaggtgggaccgataactggggtgaagtcgtaacaaggtagccgtatcggaaggtgcggctggatcacctcctttctagggaagagaagaagtaagggctgctgtctattgttcagttatcgaggaatgctggaagaggcatagggcgccgtaagaaggcccgatgcgattttctggcggcgatacgcccaggggcaacacccgttcccatcccgaacacgatggttaagccctgggaggccgatggtactttactggagacggtacgggagagcaggtggctgccagaatcaaaaggaaagggaaggcggaagcctttttgacatagacgggcttatagctcagccggttagagcgcacgcctgataagcgtgaggtcggtggttcgagtccacttaagcccatgtactgaacgcctggagaggtatttccgatcctggcgagaagacagttcccaagccttggcgaggtcctatcgagcctaggcgcacggaacctttgttatgcagaagcatatgggaacaggcaccagacgggggattagctcagttgggagagcgcctgccttgcaagcaggaggtcacgagttcgaatctcgtattctccactcgatgcgcgccgcgcatcgcatatgtaccttgaaaaccgcatacatggaaatacaaaatgatcaagaagaatatctagatcaagacatccgaggtaatcgcggaagcgattattcataacaaaccagattcgaggcaacgaatagaaaaaatgccgactggccaacgccggcaacgctatgccgacgtaggacttgagcgccgcccgtgcgccgctgtccgcttggtcatgctagaaagagcatatggtggatgccttggcactaagagccgacgaaagacgcgataagctgcgaaaagcttcggggaggggcaaataccctttgatccggaggtgtctgaatggggaaacccgcatgagaagccctcatgcatccctgcgccaatccataacgcagggaggggaacccggcgaactgaaacatctaagtagccggaggaagagaaaacaacaagtgattccgtaagtagcggcgagcgaacacggaggagcccaaaccggggcgcgtgcgccccggggttcggaccgcataattgatccgcgagaggtagcagaacggctttgggaaagccggccagagagggtgaaagccccgtaagcgaaaccgggagcggcaaggcgggatccagagtaccacgagacacgagaaaccttgtgggaagacgcggggaccaccccgcaaggctaaatactccttagtgaccgatagcgcatagtactgtgaaggaacggtgaaaagaaccccgggaggggagtgaaagagaacctgaaaccatatgtttacaagctgtggaaccgctttataggcggaaccgcgtactttttgtagaacggtccggcgagttacgccggctggcaaggttaagggctaaaggcccggagccgaagggaaaccgagtctgaatagggcgagcgagtcagccggagtagacccgaaaccgggtgatctatccatgtccaggttgaagttgccgtaaaaggcaatggaggaccgaacccacatccgttgaaaagggtggggatgaggtgtggataggggagaaattccaatcgaacccggagatagctggttctcctcgaaatagctttagggctagcctcatacgagtcttgcggaggtagagcactgaatttcctagggggcgtcaaagcttaccgaagaatatcaaactccgaatgccgcgtagatgatgtatgggagtcagactgcacgagataagttgggcagtcgaaagggaaagagcccagacctgcggctaaggccccaaaatgtgtgttaagtggaaaaggatgtgggatttcgaagacaactaggatgttggctcagaagcagccatgcattcaaagagtgcgtaatagctcactagtcgagaggttccgcgccgaaaatgtccggggctgaaacacactgccgaagcccagggatgtacgcagtacatcggtagaggagcattggatgcgggaggaagcggcaccggaaggagccgtggaccgcatcgaagagagaatgccggaatgagtagcgagaggaaggtgggaatccttccggccgaatatccaaggtttccagagtaaagctgatctgctctgggtaagtcggggcctaaggcgagggcgggagccgtagccgatggacaacaggttgagattcctgtaccgcgatatgacagaactgtggggacacgcgtggaaagcataagccgggaatggaaagaccggcgcaagcggggtaggggctgcataggcaaatccgtgcagcgcaacccgaagccgcgacgcgaaccgaactacgagtagggaagtatgcgagccatgcgtcaagaaaagccgctatcgctcatatcgcgcccgtaccgcaaaccgacacaggtagatgaggagagaatcctaaggccgacgggagaagcattgtcaaggaactcggcaaaatgactccgtaacttcgggagaaggagtgccatagagatatggccgcagagaattggcccaagcaactgtttagcaaaaacacaggtctatgcgaagccgcaaggcgaggtatatgggctgacgcctgcccggtgctggaaggttaaggggagaggttaggagcgatccgaagccttgaacttaagccccagtaaacggcggccgtaactataacggtcctaaggtagcgaaattccttgtcgggtaagttccgacccgcacgaaaggcgtaatgatttgggcactgtctcgacaatgcacccggtgaaattgaagtaccagtgaagatgctggttacccgcgccaggacggaaagaccccatggagctttactccagcttgatactgggatccggtattgcatgtacaggataggtgggaggctaggaagcgatgacgccagtcgtcgcggagccgctgttgggataccacccttgcagtgctgggtttctaaccagcagccgtgaaccggctgggggacaatgtcaggcggggagtttgactggggcggtcgcctccgaaagggtatcggaggcgctcaaaggtcctctcagaatggtcggaaaccattcgcagagcgcaaaggcagaagagggcttgactgcgacaccgacgggtggagcaggtacgaaagtaggacttagtgatccggtggtataaagtgggattgccatcgctcaacggataaaagctaccctggggataacaggcttatcactcccaagagttcacatcgacggagtggtttggcacctcgatgtcggctcatcgcatcctggggctgaagtaggtcccaagggttgggctgttcgcccattaaagcggtacgcgagctgggttcagaacgtcgtgagacagttcggtccctatccggcgcgggcgcaggatatttgagaggagctgtccttagtacgagaggaccgggatggactggccgctggtggatctgttgcgcctccaggcgcatggcagagtagccaagccgggacgggataaacgctgaaggcatctaagcgtgaagcccccctcgagatgagatatccctggcgacaagccagtaagaccccttgaagacgacgaggtggataggatagaggtggaagtgcagcaatgcatggagctgactattactaatcggtcgagggcatgaccagagaggccggaaggcgaggaggcccgggtctggggcgttggatggaagtatttcccgtatgcggttttgaaggtatatatgtaccttttaataaggcccagtggctcagttggttagagcgccgccctgtcacggcggaggtcgagagttcgagtctcttctgggtcgtttaaatgggatcatagctcagctgggagagcatctgccttacaagcagagggtcataggttcgagccctattggtcccacttaaacaaaatggatggattcccgagtggccaaagggggcagactgtaaatctgttggcgacgccttcgaaggttcgaatccttctccatccactaagatgtagaatatacatcttttaagccaaaggcttgtgccgatgtggctcaattggcagagcagctgatttgtaatcagcaggttatcggttcgagtccgatcatcggcttagtctttcataagacattaaatataatatcgcggggtggagcagtctggaagctcgtcgggctcataacccgaaggtcgtaggttcaaatcctgcccccgcaactcgcacgaatgtgcataattgaatactttatgtattagcccagatagctcagtcggtagagcagaggactgaaaatcctcgtgtcgctggttcgattccggctctgggcattttatttaccaaatattcgatatgggcgtgtagctcaggtggtagagcacttgacttttaatcaagttgtccggggttcgaatccccgcacgctcatggaatgagagggagacagataccgtaataggtactgtctctttttactttaataagtaaatgtgttgacataaggaatattttcttgtatattaggtaataataaaagggagtaactggcgcttaggtctaatagtccggcgtttgcgatgtcgtcagtacgatgagcaatcatccgtatcgtaatgaaatggtgagacttttattgcatagtaattctgtgcaataggggtctatttttttatcccattgcaggaggaaagagagggcaagcaatgctaacaagtgaacaagcaagaaaaaaccaagagatttatggatttaatgaactggtagaaggcaagaaaaaaagcatgatccagatattcctggagcaattcaaagattttcttgtcattattctgattattgcagcaatcgtatcaggctttctgggagatgcagagagcgcggccgttatatttatcgtcattactattaatgcgattctagggaccgtgcagacggtaaaggcagagcagtcgctaaacagtctaaaacaactgtcagcgcctgaggcaaaggtaatcagagatggcgtggtgatacagataccatccagagaagtaactgttggagatgaggtagttattgaggcaggtgactgtattcctgcggacggaaaacttttggagtgtgcaagcctcaaggtcgatgagagcgcgctaacaggagagagcctgtccgtggagaagtcgttggaagaggtgccggagggcgctgcattgggagaccagacgaatagagtgttctctggaagtttttccacatatggaagagggacatttgaagttacggcaattggaatggagacggaagtaggaaagattgccaaactattgaagacaacatcggaaaaacgaacgcccctccagataaatctggatgattttggaaagaaactgtctatcattatacttgtattctgcgcagttctatttgccatcaatgtgataaggggcggttctgcggtagctgcattcttatttgcggtagcactggccgtagcagcgattccggaggcgcttagttctatcgtgacgatcgtactgtcatttggcacacagaaaatggccaaggagcatgcaattataagaaaacttcaagcggttgagggcctggggagcgtatccatcatctgctcggataagacaggaactctgacgcagaataaaatgacagtggaagactattatgtggatggaaagagaatctccgtggctgatattaatcttgataacagaaaccagaagatgcttcttaattgcagcatgctctgtaatgattccactaatacagatggacaggaaataggagatccgacggaaacggcattgatcaatcttggaagcaatcttggcatggaagcggctatgaccagggaacggtatcctcgtatgtcggaagtcccatttgacagtgacaggaaattgatgtctacagcacatgtcttcgatgatcgatatgtgatggtagtcaagggggcggtagatgtccttctgaggcgtatgagccacatcaggattggcgatactgttagggagataacggacgaggatcaaatgcagatcgagatacagaatctggagttttccagagacgggttgagagtcctggcattcgcatataaagaactggatggagagaaagaattatctatagaagatgaagagggccttacattcctgggattgatcgcaatgatggatccgccgagagaagaatccaaagcggcggtagaagaatgtataaaagcaggaatcaggcctataatgatcaccggcgatcataagattaccgcggcggcaattgcaaaaaggatcggcatactgaaggatgaatcagaggcttgcgaaggcgctgtgatagaagaaatgtcagatgaagaactgaaagattttgtagagaagatatcagtatatgccagagtatccccggagcataagatcagaattgtgcgggcatggcaggagaaaggaaatatcgtagccatgactggggacggggtaaatgatgcgccggctctgaagcaggccaatataggcgttgccatgggaattacaggaagcgaagtatccaaggacgcggcggcaatggttttgacggatgataactttgcaacaattattaaggcagttgagaatggacgaaatatatatcagaatatcaagaattccatacaatttctgctgtctggaaactttggcgcaatattggccgtactgtatgcatcaattgccggacttccagtaccatttgcgccagtgcatctgctttttattaaccttctgaccgatagtcttccagccattgcattgggactggagccgcattccaaggaagtcatgaagcagaagccgcgccccatgaatgaatctatccttacaaagcagtatcttctgagcataggcactgaggggctcagcataggcattatgacgatggcggcatttttgattggatacagatgcggcgatgccgttctggcaagcacgatggcatttggtactttgtgcaccagccggcttgtccatggatttaactgtaaatccagccgtccggtattatttacgaaaagattttttaataatatctacctgatcggagcatttttaattgggcttgtgctgattacaggcgtactgatgattccggggctgcaaagaatattcaaagtagcaagcctaaatattgggcagctgcttacagtatatggacttgcattattgaatctgcctgtggtacagttgttgaaatggattagaaattctagataggaacaggagattttatggaattaagtagagagacggtaaaaagaataaaaggattgattgtgtttgccgcattggttgtagcctgtctgtggaagtatgatgtggtggtatcggttcttgcatttatctttcatgtcatatttccattcgtgcttggcggagcgatcgcattcattttgaatgtgccgatgaattttatacagaggcatctattcgcgccggagagggtagaaaggcataagatacagaagaagattgcccgtccggtcagtatgctgatcgtaatattcggagtgtttggcattgtggcacttgtaatgtttgttttgattccacaattaggggatacattctctaatcttggaagcagcattcaggcgtttatcccaaaagtacaggaatgggcggaaaaattattccatgacaataaggagattatgacctgggtcaacagcctgaaattcgattggaataagatcatggacgcaggcatagatttcttcaagaatggggcagggagcgtgcttgattctacgattactgccgcaaagagcattgtgagcgggattacgaccttctttatcgcatttgtatttgcggtctatatcctgcttcaaaaggaaaaactgggtattcaggctaaaaaggtcttatttgcatttgtaaggaaaggccgggctgaggctgcaatggaagtattatctttgacctacaatacgttctcaaacttcctgaccggccagtgcctggaggccattatcttaggaagcatgtttgtcataaccatgacgcttttcaaactaccctatgctttgctggtggggattgtgatcgcgtttacggccttgattccaatattcggcgcatttatcggctgtgccttgggagccttcctgatatttatggtagatccatttaaggcgcttatgtttgtaatcttgttcctggtactccagcagatagaggggaatcttatctatcctcacgtagtaggtaattcagtaggacttccatccatctgggtattggcggcagtcagcatcggaggaagcctgttggggatcgttggaatgctgatttttataccgattatctctgtagtatatgcgctgttcagggaaatcgtctacttgaaattaagacaaaagaagattaatcccaaagaacttgaataaccgatccaagaaaatctgttataatattgtagtgttaaaaaattttagcgttgcgaatgggatcgtgcggcaggatatggtacagatatattatgtacatcaataaagaagacagacggagcagggccataggcaagggtcctgctctatattactctattgcgcctgctacgaacggtccataattttacagtaaatgacggcaacagccgtacttatggcagtggaaatgattccggcgcctacgatggcagcaggattgacgcttccatactggctccggtaggcaatgacatttaccggaattaattgcagggaggagatgttgataatcagaaaggtgcacatctcattactggcaattccctttggacgtaccggacctggaagccggtggcttcgcctgtcttcctctaatttaccgagttcgtccatggcgcgcagtccggctggcgttgctgcccagcccagtcccaggacattggctatgatattggtggtgatgtgttcctcggcagggtgcccggcggggagtcttgggaataagaagcgtataatcggacggatctttttggaagcgcccttaatgattccggccttcgtcgcaatctccataagacccacccagaaggacatgacgcccatcatagtgatgcacaaggtaatggcctctttggaagagtcaatggctgcattggtaatatccggcatgcgtccggtaaaggcggcaaagataatgccaatcagtatcatgccggcccacagataattcagcatataaaatcctcgtctggctttttaatataacgtatgagccgggatggatatttatcacaaagacataagaaagaggcggaagcaattggttccttgcttccgccatcctttgtgtctactatttgattacttctttgataattctgtgccagttcttataggcgatcttttcaatctcatcttcgtggaatccgacgcgcttcatttcttcaatgacatttggtacataagaagcatcctcaagtccgatggtaaaaggagtagactggctgctgaaagagcccaaggtatctccctccaggaattcagaaaagtcaaatccgaaaccgacatgatcaatgcccattacttccaccatatggacaagatgttttaccaggttttccagagtctgcttatcttcctccatatgaacgaattcgttgaatgaattgagcccgactatgccgcctgtgcgtgccagttcttttaactggtcatccatcagattccgcgggcggttgcacagtgcccggcagttcgagtgggttgctacaacagggcctgtggcagtgtcaaggagatcccagaaggacgcatcatttagatgggatacatccagtatcattcccagatcctgaatctttctcaccgccctgcggcctacgtctgttaacccacgctccggggtgccaagggctccggtagccagaggattttcctcattccaggtaagccctgcatgccttgcgccaaattggtagaactcgtcgataaggtctaagtcttccccaatgctctttaaaccttccagtccgataaatgcatacatctttccttcgcttcttgcagtcatcatatcggagtatgagcgcgataccttaaggatatcagcacaatcaggctcttcgcaggcaatggcctccatcatctggcgggtacgcttcagcgggtccttgtcatagggaggatcattccatattacgaagatgcctccttcgatctgcccttttttcagccgttcataatgatatttacggaagatatcacgttctccctttagatggtgctgcgttacatcggtccaaatatcagaatgtgcatcaaagttcataaaaacacttcctttcttttgtgtagataagtctaaataaatcagggacggacagttgtccgtccctgatcattttcctggattcaggatgttattcagttttataatcctaagatgctgcctacaatcaatccaaagtatgttccaagtacatatcccagagtaccaatcagtacgataggtcctaccagcttggtccagcccttagatacagccatagcaacggccgttgttggtccgccgatgttagcattggaagcaaggataatatcttccagattgaacttcaataactttccggcgatcaggctgaaaagcatatttacgattacgatgatagccgcaaataagagcagtaacggcgaattcttgataatcataggtacggatgccggaacaccgattacgaagaagaacaggtagattaagaatgtacccagttcctgcgtacctttgatctcgccaaagaacttaggtgcaaatgttgcacaaagcatggcaattgtcgtaatccataagtacatatttccgaacagcgtattgattatctgcaggaatgtattagatgtcggtattacgcctgcaagtcctgtagatattacgttagacagcgcaacaatgacaaatcctgttgcagcggccaatgcgatatctttcagggagatttcttttctgccccagaacgcagaagcatttgtctcattttcctttacattggctccggcagccgcttccacttcatccacatatggatgcttgaaatgcttgcggaagaatccgatagatggcattgctatcagtacgaagaagtacagtaccatcagcaagttatctgcaaccgttgcagcagatatcatgtcgccagatacatcgaatgctgctccaagagcggcaaagtttaccgtgcctccgatataggttccggtaaatacgcccgcaagtccggcaagttccggaataaatttgtggagcgccgcataagcaagaagcgcgccgcaagcggtacctaccgagccgatcaggaatataatcaggatacgtccggattcctttccgatctttctcatatcgcactgcagtaataacagaggaatggaaagtggtacaacgtaaccccatacggcatcccatacaggagcgtccattggaatgattccaaagttcgataagatgattgcgaaaatcagtgcaacgatggcaccggtcatttttgctgcccatttatatctctgctccagatatattgcggcagcggcgccggtagcacagatagcccacagcacccatgtgttatccgctccaaccagcggattttgtagatcgaatatatgtccccacatactctcgtcctcctttcaaaaatccttttttgaagaattttcgtcaatttttacaattgaactaataacagtatacaaaaattgtcaataaaagtcaatgaatgtgaagaaaggacaggattatgcttggaaaatcaaaggaaatccttgaattttacagaaaattactttcgtttgtccagagtcctccatacagtcagaagcatggtgacgaaacaggccgttcctccgataaaattagatacaggctctgcaaggaatactccgtctgtaccaagactggctatggtaggaagccataacgtcagaggaattacgatgataaccttgcggaataaggaaaaaaatacagcctgcctggatttgccaagcgctacaaaggttgactggccagcaaactgcagggccatcataaagatgccgaagaagtacaggtgcatggcaggcacgccttcttttaacagtttcggatcgctattgaacatccggatgaagacgtgcgggaaaaagaataggaatgcccacattaccagagtaaatacaatacaggatatagcagtaaaggaaatggcagacttcacccttccatatttttttgccccataattgaaactcataatgggctgtgccccgctggtaattcccatgactggcatggttataatctcccgaacggaattgattaccgtcatgattcctacatacaggtcgcctccgtatctctgcagggtagcattgcacatgatctggacagaactgttggtaattgacatgacaaatccagataagcccagggcggagatttcccttataagcgagaaatttaaatgtaattgttttcttgttaattttataattgctttttctcctgtaagaaaatgaagtacccagatgcaggagacacattgggataggatagtggcggttgcggcgccacggacgcccatatgaaatacgaagataaacagtggatccagtacaagattcaaaagcgctccgattgagacggtcaacattcctgttacgccgaatccctgagcgttaataaaattattcatgccaagactgaccatgacgaacaaggtgcccagaagataaatactaatataggcattcgcatatggataggtcacgtcgcttgctccaaaaagatagaggagcggatgtttgaacaggtagcagaagacagcaagaagagcgccggatgcaaggagcatggcaaaagaattccccataatccgttctgccctctctggctcgtctgctccgcgcgccatggaaaacagaggcgcaccgcccattccgaacagattggcgaatgcggtaataatagtgatgacaggcagggtaagaccgatgcctgtcaatgcttgcgtggatgtatgcggaatgtggccgatatagatgcggtccacaacgttatataagacattaattaactgggccagcgtcatgggaatggccagacgcagaatattggccgagacgcttccctggccaaagtccttttctttgttcatgaaatcaccgctttttccagagccagagtgcagcaatgattccaatcgtatacaggatgctgactaggatggaaggattatcttttaataaataagtaactgcaacgacggctgcaagagaaaccgttagctgaaatgcagtgaagatacgtttttcgcgggtttcttttgcctgctggctcatttctgctctcttctgctctaattccaggtatttcataagatccttttcattgaggtgggaaaggatccattgatccctggaaaatccgtcctcatcgtcttccgatgaataagaatccattatttttttatctggcttttcctttttgaaaaaatgaaagtctttttgccgctcagattgtggctcttcagaagaagacttttcctctttcactttgtcttctttggcttctgtttcaggcgatgtggctgcctttggctcatcagaagtatcaggggcagtcttcggttcttcagatgccttcacttctccagcggtctcgggtgctgcgttcttttgttcttcagtcataggatgttcctccgttaggtattttatatatgctacatgtattgcagatttatcttcatgatatagattgtagacgtttttccacatattttcaaggctattcagcatatattgggaatagacttcacacggaaatgaggatgcccgatgaaattattcatgtatgtcacggattttatcgttccgctggtaatattcggaattgtcagttatggagtgctgatgaaggtaaatgtctatgataccttcatcaaaggagctaaaagcggctttttcacggtaattaaaataatgccgacgctgattgggcttatggtggcagtaggggtgctgcgcgcttcgggattccttgactttctgtcaggaattatcgggcagttcacggaatacatcggatttccaggagaactggtgccgcttacagtggtaaagatgttctcatcttcggcggccacggggctgcttctggatgcgttcaaggagtatggaacggactcgtacataggactggtggcatccatcagcatgtcctgcacggagactatattctacaccatgagcgtctactttatgacagccaaagtcacgaagaccagatatactctggggggcgccatgcttgcgacctttgccgggcttgtggccagcgcggtgctggctggtatgatggtggccgggtaagggggtgcctgtctttcatcagggaatccggcataaagacgcttttagggactctacgaataattgggccagatgagtaagataagcatccttttgatatacggcggccaaggaccaggacaagtcaggaagatcaagggcgaagtaagtaacgtttccaggatgattgcagactttggccccttcttctggaaccaaggtacaggcaataccggtggccaccaggttaattgcggtggtcaaattgccagtttccaggagaatctctggttcaatgtgatgctttccaagaatatggttgatttcatgagtgagattctgccctggcttagtctttataagcggaagctgaagaagcgtcttggcaggcgcgataggatacccatcggaaatgcgggcagcgtccaataaggtacgaatgtatggatgccgtgtaggcgccgccagaagaattcgttcttcaaagataatatcgctggtcaattttcggtaatccaaggtatgggggagattcatgaccgcaatatccagttttccattcatcaaagctaaggcaagcttgtcagaatgatcttccatcaattcaatgcggatgccaggatactggcgatgaaattcaggaaagatatctggaagcaggcaggctccgcgccagaaagcgacgccaagtctcagacatccgctttcctggttcttgatatcctggaattctttttttatattttcttctaatctcatcatctgttttacagactcataatatcgttctcccgtataagtcaattttaatggagatgtcctgtggttaaacagctctacaccaagttcagattccagacgccgcagatactggctgagggaaggctgggagacatataggatttctgccgccctggtaaggcttccagcttctgcaattgcaacaaagtattcataattccgaaacatcatgacacatatcccttctaatgattataatattaatattataatcattatatcactttatgtctttgactgaaagcaatataatgggtaaaataagaattgaaaacaacattgtgcacaaaatactgttgtataattaattagagattagcaaaatgacaaaaatataacaaagattagtaaattaataaatataatatttttgttatgaacaattgtgagggataatatgtttgatctgatcataagaaatgggcacttgatggatccccgctgtaatctggacaagcaggcggacattggaataaaaggccgtcatattgtggacattgggaatctggaaggtaaggagtgcttgcagtcggtagatgcaaaaggctgtctggtggtacctggactcattgatttccatgctcacgcagcatatggaatcagtgatttttctatgccggccgatctcgtacagattccaagcggagttacatctatggtggatgctggatccacgggagtcacagattttgaggcgttttatcaccgtaatattattaccagtataatgacggtcaaaagttttctgcatgtggcaagcgaagggcaaaggacgcatctgaaatacgaaaatccggatcctgcacgatatgatctggaaaagataaaaatgctgtgtgaaacatataaggataatattataggcttaaaacttcggcaaagcagggacatagtaggggaactcggacttaagccgcttgaaggcgcgcttttactgggagaagaagtagggcttagactgtcggtacatgctacggactcgccgggagatatcagggatacgcttagtctgctgcgcccgggggatattttctgtcatatgtatcatcagaagggacagacaatcctggatgaaaaagggaatgtgctgccggaagcctgggaagccagggaaagaggagtcctgtttgagttagggcacggggcgtttaatttttcgggaaagatagcgaaggctgctatagagcaaggatttctgccggatattattagttcggatttgagcctgctgtctgcgtttaaagagccgacgtactcattttcatatatcttgtcagaacttttgaatcttggaataggattgaaagatattattaccagatgtacagacatccccggacgcctgatggggatggagcagggagggctatctgaccgccttgtagactgtgtggagaagttgtttggctggtttcctggaagcatgggaacgataacgattatatgctgtctgttctttgcatccctgactggatccggtccggcaacagtcgctgctataggcgcgattatggttcctacgatgctaaaaaacgggtattcccggcgggaagccgccggacttctggccgcgggaggggccctgggaccgattattccaccgagcattgcgatgatcgtctatgcgacaacgatgggcttgtccgtaccggagatgtttatggccgccctgcttccaggcattcttctaggagcagcatttattgttacaaatacggtgctggtagtccgcaagggaatgaaaggagagcggccgcattttacggcaaaagaactggggagatctatctggagggcgctgggggttatctttcttcctattctggttctaggaggcatctacgggggaatctttacgcctacagaagcagcaacgattgctgccgtatatgcgctgatactgggactggcataccgggaactgaatctcgggaagattatcactgccatgaagaaaacagtaacgacatcagcaatggttatatttattgtcggaatatccaatgcatttggaaccgtgctggcagcagcgaatattcccaagacgattgccagcgtgatcattccatatctgaacagccgggttgtctatctgctgcttttgatggtgcttctcttcctggtcggatgcgttatggagacggtatcttctattgtaatccttgcgccgattctcgttcccatcggcatatctatgggaatcaatgagatgcacctgggaatcttattcagcatctgcctgattgtaggatttatcacgcctccattcggactgaacctgtttacatcagcggcgacttcagaagtaagcttccaagaggtggtaaagggagtccttccctatctggcggcggctctggccgtggtagtgctgatagcattcattccgcagatatcgctggcattgcctgaacttttgggatactaaatattagaatatatacataaggagtttgaatcatgaaagcaattgtagtagataaagattatgggagcgtaagcgcccgggaacttatggaagtgcaggaatcctataagcaggctggcattgaactcgaagcatatcattttcagacagaggaagaaatcatggaaggatgcagaggtgcagacgcaattcttgcaacgggcaatcctcctataaccagaaaagttatggaggcgctgccggaattaaagtttatacagagatttggggcaggggttaattccatagatcttcatgcagcggcagagatggggaagattgtccttaatcttcctggattctgcgcgaaagaacttgcagatcttgcaactgcgatgattctgggattgatccgcaatacggcatattatgaccgtgaaattcgcaagggaaaatggccgaagtgccaatatcttcttccgggggatgttcggcagatgacccttggcctatatggattcggcgcggcaggacgttatctgcatgatatttttcatggaggatttgggacaaaagtaatcgcatgtgacccatacgtgacggaagacgtaaaaagacggtatccggatgtagaattcgtggaattcaatcgaatgcttaaggaaagcgacatcatatccattcatgtggtcctgacgcctgagacaacgcatgtgttcaacgaagatgcgttccggcagatgaagaagacggcgatgattatcaacgtatcccgtggcccggtgatagatcaaaaggcgcttgcatgggcgcttgacgaaggagaaattctttatgcgggacttgatacggtagaaaaggagccgattgatccggatgatccgcttcttcaaatggataatgtaatacttagccctcacagcggctcttatggagcaggcgcaaagaagacacagattcagatggtgtgcggcctgcttccggaggcagtgaaaaatggaaggattcccgccagaaatatagcgaataggggcgtaatagaaaaaataacggaatatgagtttgtttagaggaggagagtatagatggcagcaggatgtaagattataaaagagttttgcagaccagagaaagatctggttatgcgctttaaagatatgccggtagcgaatattgatgataacatgggaagggtagcagctgtagacaattctatcctgccagtgggaaaaggacagcttcttggtaccgcgtttacagtgagggttccccagggagataatctgatgttccatgcggctatggatttggcgaaacccggggatgtaattgtcattgatgcaggaggctttgaagaccgcgcgatatttggagaactgatggcatcctattgtaagaaacgaggaataagaggcattgtatgtgatggagcgattcgcgacagaggaggccttgcggcaatggaagattttccggtatatgccagggcaacgacgcctaacgggccatataagaacgggccgggagaaatcaatgtgccagtatgtattggcggaaaggtagtatatcccggagatatcgtggtgggagacgaggatggagtactctttatacgccctcaggatgccggcaaaattgctgatgcaacccttgcagttgaaaggaaagaggcagatattatggaacatattatagaggatgggacctatataagaccttgggtaaatgagaagcttgaagagattggatgcgagatagtcgaatagtcaaagggtaaatttaatacaatgtagcaagtcagggatggagacctattaaaaaggcttcatccctgcttggtatttatccagactataacggtagaaatagtccggcaaaaatgataaaattagaaagatctatgaaatcaaggacaaattggagaatacatatgcagttacgcaatgagatcccggatacgttctggggcctgttccggtccgtgaaccgggagatatacattgatgcgctattatatatcaatgaagaataccaatataataactatttccttaccaaagaagcatgcatccaggttttaggcgatatgaacgccaggaagcggtacgagcttaaatgggaggaaagcgagtcggaattcgatatgctggagacgccgtcatcccgtatcttgaactggcttcttcggaccggatggcttaaacggatagaggattataatacgctggtgaccaatatcgtgatcccggactattccgccatatttattgacgcttttgaacgcctcagttccgaggatatggaagagacagacatctatatccagaatgtctatgccacgttattttcctttcagaacgatgcaagagccaatctgggcatgcttcgcactgccttggtgaatacacgcaggcttaataaggcgctgcaggatatgctccataatatggacaagttttttgcacggctgttggatcaaaagtcttatggtgatcttctaagagagcatctggacgggtatgtggaggaaatcgtcaggaagaagtatcatatcttgaagacttcggacaatttctatatctataagatggatattaagaagtgcctgcgcgatatgcgggaagatgaagcgtggatagagcaggtaagagaccgttcaagggccatgggagatacaggagaggatgtattggaacttctggatcagatcgagaggggattcgatgatatcgagcacagaatcgccaacatggacaaagaacataccaaatacgtccgcgcgacagtaaccaggcttaactatctgctgagcggagagtcggatacgaaaggcctggtcataaaacttctgaaccgtatgtcagagagcgcggattatgatgaggtgctggcaaagacaggggagaagatgaatctttccctgctggagatcttatcggagaagtccttgtataaaaggcggaagggccgaagagactttatcagccagatggagccggatgaagagattgcggaccttgacaaggaagatgtgctgaaacttaaccgcatccaggtacgctataccaaggaacagatagaggcattcattgaatcccacatgaatcaggacgagattatggatgcggctcaggtagatatcatggatgaggaaacctttgaaaaactgatcttggcctatgattacagtaccagaaggagcagcaagtacatggtgctggaagaagagccaaatatgatagaaaaagggccgtataagtatccggcgctgaagtttgtaaggagaagattatgatagactattttgaacagctaagccaggaagagcaggaggatatcacggaggtaatccagatcctgtaccgccagacatttctgctggagaggaagtatgacaaaagatccgggcgcatgcagtatgtgcgggagtatcggatatgcagcaagcatatggaattcttaagggcatattataaagtcgcgggaattaccttgaaagagaatgcccatatgggcctgatctatatccagggggaggctttgtggggagagaagctgccaaggcttgcaaccatctatctgctggtattaaaactcatctatgatgagcagatggcggcggtatcttccagcagccatattgtcaccacgctgggggcagtcaacggaaaggcgggagacttccgggtgctccacggcctgccttctcctacggaaatgcgccggaccatcgcgcttcttaagaaatatcagatcatagagccgctggatgttctggaggaattgaacgagcacacgaggcttatcatatatccctgcattcacgcggtgctgatgggggatgacattaaggaactgttagagacatttggcgaggaggagaacattggagacgaagcagccattcaaagcactctcgaggatatgcctgaataactggcattatatagataagaagatactgactttaagcgaagggattaatttctttaccggccattccggaagcggcaagtctacggtgatcgacgcgatccagatcgttctgtatgccaatacggatggccgcgggttctttaacaaggcggcggcagacgattctgaccggagcctgatcgagtacctgcggggcatggtaaatatcagtgagaataatgaatcccagtatcttaggaataagaacttttccagcaccatcgtactggaactggaacagaccaatacaagagaaaagcagtgcgtaggcgtcgtatttgatgtggagacggctaccaatgagattagcaggctgttcttctggcatacgggagaacttttaaataaccattaccgtacggaaaaaagatgtctgacgaccatagaaatgcgggagtatctgcaaaggacatttccgtcggaaggattctactgcggtcccagcaatgagagattccgccgccagctctatgacatttatctgggcgggctggacatggagaagtttcccaggctatttaaacgggcgatcccgttccgcatgaatatcaagctggaggactttgttaaagagtatatctgcatggaacaggatatccagattgaggaccttcaggagagcgtcatgcagtatggacggatgcagaataagatcgaagagacgcaagaagagatcagaaggcttaatctgattcgggagcagtatgaggaattctgcaaagatcaccgggaagtggaagcctgcacgtaccagattgaccggctggaagaactctggctggaagcaaagatccaggaatgccgggataagacgctgggacgccaggaagagatcggcaaacaggaaatggttaaggaacagctggaatcacaggccagaatcctgcagaaggaatatgaggatataattctcaggatcgccgacagcggatatgccaatctggagtcagaactggctggccttaatgagacgcttgagaggctgggtgccagcaaggcacgctgggggcagacggccgaccgcctgaaagagtggaagcagcaggatgtgacgcccaaccagaccatctgggatatcgacaaattcgcggacggaagcatttctgaaggagaacttgagaggctcaaggagagccttctggacattcaggaagaattagaagagcagcgccgggaggcagactccgacctgcgcaagatcaagaaggaagaaaaggatgccagagaggaattgaaggaactgaagcaggggaagaaggcatatcccagggaactggaggaggccagatacgaactgcgcaaccgtctccacgagcgatgcgggaaattcgtcaacgtacagatactggcagaccttctagatattaaggatgagcggtggcacaatgccatcgaaggctatctgggcggcaataagctgctgcttgtggtggagccgggctatgccagggaagccatggacatctaccaagggatggacaggaagaagtattaccgtgcggctgttctggacacggagaaggtcatggaggatgggcaccaggcaaaggcaggttctctcgcagaagaaattgtggcaaaagagccctatgtcagggtctacatcgactttttcctgggaaatgtgatgaaatgcgaatccatagaggaactgcgggagcaccggattggaattacgccggactgcgtcttgtatcacagctatcgtctgcagcatatcaatccggagaattataccagaagggcctatatcggagagacgagtatgcgaaagcgtatccgccagctggaagagaaatgccagaaactacaggaagagcgtctgcctctgcaggagatgctggaggaaatccgaaagactatgcagttggaaatgctgatgcagccgatctccgattatctgggctggctgtctgatatggaacagattccggcaaaagaacgaaggaagaagcagatcatagagaaaatgcagcgcttaaaagaagaatccgtggatacctggaatcgtcagaaagaggaaatccagcggcagcaggaggataaaaaagcgcagatcgatcaggtgcagaaggacatctggaacaaccagagggatattgaacgattccgggaggaacttatacagtccgagtccgcattggcgcagcagaagcaaaagaccgtggaaaatcctgtatatgagcaggaattccaggagtaccttgcagggaagaaatcttccaattatgaatatctaaagcggcagaggattgcggagcgctatccgaagcaggaacgggaggagcaggcataccagaaactggtggacatccggggcgaatacctgaggaattatccgaaccgtacctactccgcggcaatcaagaataacgaggcttacgacaaactgctgaacacgctgcagtgcgatgatctggaagcctaccgggagtcggcgaaagaacaggcgcgccaggcggtggaacactttaaggatgactttatctttaagatacgaagcgccatccgggaagcctaccagcgcagggacgagctgaaccgcatcattagcaggctggacttcggaaaagacaagtatcagttcgtaattaccaggaataaaggggccgacgggaaatattacaagatgttcatggacgattcgctgcagatcaatccaagccagctgactaataccatagacaatcagcttaatatgttcaccatggagcatgaggatcagtacggggacctgatgaatgaactgatcaacatcttcattccgccggaaaacgcaaccaaggaagaactggacgaggcgaagaagaacatggacaagtatgcagattaccgcacctatctgtctttcgatatgcagcagatcgtaagaggcgataaagatatgaccatcggtcttagcaagatgattaagaagaactccggcggcgagggacagaatccgctgtacgtggcgcttcttgccagtttcgcgcaagtttaccgcatcaacctatcgcccaaaatccacagaagccccaccatacggctggtcgtactggacgaagccttctccaagatggacgcggaaaaagtggccagctgcatctcgctgatccggggactaggcttccaggccatcatcagcgccaccaatgataagatacagaattacctggaaaatgtagataagacgtttgtgtatgccaatccgaacaagcggcatatctcgatacaggaatttgagaaaaaagattttggggaactgaaagattgaaagataacacgtaacaatattaagatgtgcacgtaacacttttcaaaagtgttacgtgcacatcttaatattgttacgtgtcaaaccgcactaactggtgtgtaaaattgaaaggagcgtgccagaatgtatacagtggaagtgccggagtttcacgggctgataggctgtatgctggagacagggcttgtgattgagcaggaaagttttttgatttagctatcttttgaaataaagaaactggaagaggtattggaagaagaaccgctgccattggtgagggtagcggttcttcttcaataaggaacttttgagagagggaaaaacgttatacgctttctgcgatttttttggttattctcaggaattcatcgatatcttccgtgctgttgcaatgcagcggggatacgcggatcgcgccttcgatcccgagggcttctacgattctcttggagtacatgctgcttcttaagcgctcgaatacggtaacgccgtgatcgaggtatttctgtacgcattcagagtactcgattcctttaatgcccatggcgacaatcaggtctttatatgtaaggtcttccatatctacatatacttcgacattatcaatgtgtcttaagcctggaacttcgtcggttccttccagcatgcggtagagaagcgctctttcctgtagatggatccggttcatgccttccacatacagggcccgcttatcagccttatcggcatcctctaagaaatgcgcgccgatgtcgcatacatagtcgatgacagccatcattgccgcatagtttgccggcgcaggggttccgagattccatacatccgcttctttatggatcagcttgtggtggggcagttttgcaacacggtcggatacataggcatagccgcagccgcggattccgaagaacttgtaaggcgcgaagtttgccacatctacgccccagtcttctacatcaatgaccgcatgcggcgcatgctgaacggcatcgctgatgacatagatgtctgggttgatctcctttgcacggcgcgtgatctccttgatatccatgatatttccggaaatgttggaggcagccataatgcttagaaggcaggtgtctttatctacatacttcatgacttcgtcaggatcgatgccgccggtcgccttgttggcaggaactacccggaattcccggccagtcttgttgcaatagtactccaccgcatcatgggcggaagggtgctccagggaagatgtgaccgcgttggttccccatttcacattttccatgatggcgcccacagcctggtacattgcctgggaagctgaaagttccgtcaccagcgcgccgctttttgcgccgaatacaacttccagaatttcctttgtgccgtcttttacataagattgtaactcatagcctcttccacggacacgctccggacagtcgggaaactgttctaccgcgcatttgacctctaccgcctttttaagccttaaagagccgccggagttttcaaaaaagagccggtggccatattccgggtcttcatccccatagtagaattgttcttttaagcttttctgatattcatctgagaataagattccatgttcagtattcatttttcatcctccttatctggacgttttcattaactttaaatccatcatagcacgtagaatataaattgagaaatgaataatttcattgtataatattaataaaatttatatttaaccgttcattggaaaatatgcaggatatcgtaggaggaaaaagatgaatctgtctgaaatcgaaacttttttaatgattgtgaaaacgaaaaatattacaaaaactgcggagaatctgttcttatcccagcccacggtcagccacaggcttaagtctctggagaatgagcttcaggtgaaccttataacaaggaagaaaggctacaagcagatcgagcttaccacgcagggggaggagttcattccgattgcagagcgctgggtatccatctggcaggaaatgcagcgtctcaaggacagccaggaaaaactatatctgacgatcggatgcacggacacgctgaacagcgccattttatttgatctgtacagggatatgcttaatgacaaggatcaggtcatgaacctgcatattaagacccactattcctatgaggtctacggactgctggaaaaccatgacatagacttgggattcgtataccaccatctgcatttcaagaacatcgtggcggagccggtcttaagggagaagatgttcctgatccaggcggcagatacggaattgaaaaaaccaatcatctatacggacgaactggaccctgaacgggaaatattcgtcagctgggaggcaaactatcagatctggcacgaccagtgggttggcaaaggagagcggccacgcctccaggtagatacctttgaattgttattccaccttctttccagcgagaaaatgtgggcgatagcgccagtttccgtggtggaccgcatccggagcctgcggccggtatatgtaagcgagattggaaatccgatccagccgccagagaggattacttataaaatcaagcacaaatatccgaatgaggcgaccttgaaagcagtacagctttttgaagacaagatggatgaatatctgcgcgaaagggattggggatatgttggataaatatagaaaaagttaatatattatagttaaataatttattttattaaataatgcccctatgctatactgtaaccaatcaataaaaaagagcgaaaaaaaacgggtaaaatagtaatattatacaaaaaggaggatgccggatggaagcaaaatttctaatatcaggtgattcagctatttctgtccagatgggtagcgagatcagcctggaagtaaaccagctggtgcgcatgctttttctggaccttacgaagaatcctatagaagggattgtggaaatggttcctacatacgcttctttgatggttcattaccggcctgagaagattcggtacgatcaactcaaagaagagatagagagacggcttcttagcatggagcaggtggaggaggaatcccatattgtcaaggagatacccatctgctacgggggagagctgggaccggatcttgaggactgcgctgcttatgaaaatgtatccgttgaagaattcatccgcatgcattccgggcacgaatactattcgtatatgttaggctttgcgccgggacatgcctatatggcaagattcgaagagccctttcattttaagcgaagggagacgccaagagtcagaattccgggacagtccattgtagtccagttgaatctgtctaacctgattccttttgaccagccctgcggatggaatatcataggcgcaacgccgcttacaatctgtgattatacaaaggaagacccgttcctggtacacgctggggagtgggtaagatacgtgccggtaagcctgcgggagtatcacaagatcaaagaggatgtaagaaaaggaacctatcgtctgaaaacatatacaaaggcggtgagataatgggaattatagttgagaatccagggatactgactacggtgcaggatgagggaaggtttggcttccagcagttcggcgtatcgccggcagggccgatggacacccagtccttttatctggccaacatcctggcagggaataaaagaagcgaaggcgtgctggaaatgacattttccggccctacgctaagatttgaaaaggataatatcatagcagtcaccggcgcgagcatgtcgccctgcgtgaatgggaatccgataccgatgtaccaggcggtgcttgtaagagccggggaaacgctttcctttggcatgaccaatgggaatggaagcagagcctaccttgcatttgcaggaggcctggacgtaccgcttgtcatgggaagcaaatccacgctgatgagaaaccagctgggaggcatagagggacggaaactggaaaagggagattccattggattcgtaagtccgaagacaacgcttccgaatatggagatgcgtaagcttgagccggaagtatttccgaaaaaggaattgactctcagagtagtgaccggcccgcaggatacggattttaccgaggaagagttaaagcgcttcttctggtatggtgcagagatcaccaatgaatttgaccgtatgggatgcaggcttcaaagggaagagccgcttaagcacatcggcgacggcaatatcattaccgacggaatcgcatttggctcgatccaggtaccttcgaatgggcagccgatcatcatgctggcagaccggcagagcacgggcggctacagcaagatcggaaccgtcatttccgtggatttgccgaaactgacacagagcgtgccgggatacagagtgcgtttcgtaaggatcggcattgagctggcgcagaatctttatataaggcggcagcagaaattaaggaacctggagaagcagttaggaaaatagggttaatattggagactgagaagatggaatatgagaagatcatagatttgattcatgaaatagagagttccagtatcacggactttgcacttcagaagggagagttccggatctcaattaaaaaggaagggactaaggaaccgaaggcagaggatgacaggacaatagatatagaagaaagaggcaatcgcaagcgagaaactcaggaacaggatgtcctgatagaagagggcacgatgataaggtccccgctggtaggagtcttccatgcagccaaaacacaggatggtgaagcgcaagtggcgatcggcagccatattgatgaggggcagatcctgggagcgatagaagcaatgaaactgatgaatgacgtagtggcagcttgttccggtactgtagcggaggtcctggttaaggatggagacttggtggagtacggacagccattatttgtgatcgagggataaaagtcatgtttagaaaaatactgattgccaaccggggcgagatagcggtgcggattatccgcgcctgccgggaaatgggaatccgtacggtggcggtatactcgcaggcggatgaggcggcaatgcatacaaggcttgcggatgaagcagtctgcatcgggccggcggcccctcttaagagttatctggatatgagccagattctcgcggcagccatagccacaaaagcggaagcaatacatcccggattcggattcctgtcggaaaatgcagagtttgcaaaacggtgcgaagaatatggaattgcctttatcggaccgagcggccatctgattgaaaagatgggaaataagtctgaggcgaaaagaactatgaaagaggccggcgtgccggtggtgccagggacggaactgccggtgtatgaagaagcggaagcgattgaaaaggccagggagatcggatatccggtcatgataaaggcctcttccggcggagggggcaagggaatgcggcttgcctattctgaggaagagtttgcggcggcatttcatacggcccagcaggaatcgatcagcgcatttggcgatcataccatgtacctggaacgctatatccagtccccgcgccatatcgaggttcagattatggcggataaatatgggaatgtagtgcatctgggagaacgtgactgttccatacagaggcggcaccagaagatgatagaagaatcaccctgcgcctttatttccccggtattaagggagcggctgggagatacggcagtacgcgctgccaaggcagtggggtatgaaaatgctggaacgatagagtttctggtagaccggtccggagagttcttctttatggagatgaataccaggattcaggtggaacatccgatcagcgagctggtttccggagtggacttgatccgggagcagatccgggtggcggctggccttacgctcagcgtaaagcaggaagatatcgttcttcgagggcatgccatcgagtgtcggatcaatgcggaagacccggtacacaacttcatgccctgcccggggactataaggaagatgcatcttccgggaggaaatggcatccggatggatacggccatatatccaggatataccataccgccttattatgattccatgatcgtcaaagtcattgcctatgacagcgacaggcagggagcgatccgcaagatgatcagcacgctgggagaattggagattgaagggatccagacaaacttgaatttccagtacgatgtgctgaatcagccggatttccagaatggaatgtttaatacggattttatagccagtcattatgacttgtaaataaaaaataatacgaaaatggaaatgtgaaaatggagggaatcagaatgaaaattgtagtattggatggttacactttaaaccctggcgatatcagctgggaaggaatggaggcattgggagaggttaccgtatatgaccgtaccaagccggaagaagtggtggaaagaatcggcgacgcagaggtagtatataccaataagacgcctatcacaagggaaacattggatcaatgcgggaatattcgttttatcggggtccttgcaaccggatataatatcatagacatagaggctgcaaaggaaaaaggaattccggtatccaacattcctacatatggaactgcggcggtatcccagtttgccatcgcgctgcttctggaattatgccaccatatcggggagcattccgatgcagtgaagaatggagaatggaccagcaatccggattggtgcttctggaaatatccgctggtagaattggcaggaaagactatgggaatcgttggattcggaagaatcgggcaggacacaggaaagatcgcacaggcgcttggaatgaaggtgctggcattcgacgcatatagaaggccggagctggagagcgagacttgccattacgcagatctggatacgctgcttgccgagtcggacgtgatctctcttcattgcccgttattcccggataccgaaggcatcatcaacaaggatacgattgccaagatgaagaccggagtcatgatcatcaacgattccagagggccgctgatcgtagaagaggacttaagggatgcgcttaacagtggaaaagtggctggagccgcgctggatgtagtatctacagaaccaatcaagatggataatccgcttcttagcgccaagaatgtaatacttactcctcatatcgcgtgggctccgaaggaatcacgccagaggctgatggatatcgcggttgaaaatctccagtgctttgtggatggagcgccgcagaacgtggtgaacaaatagattgctgtaaatgctcgttaagaagaaaggagtcaaggatatgtacagtgtggatttgaacagtgatatgggagaaaacttcggagcatacaaactgggcggagatgaagacatcatccagtatgtgacgacggcaaacgtagcctgcggatggcatgcgggagatcccatggttatggataaagtggtgcgtatggcgaaggaacggggagtcatggtgggcgctcacccgggatacccggatctcatgggatttggacgcaggaagatggtattatccttccaggaagtaaagaactatgtgaaataccagatcggcgcgctgtccgcatttacccagagccagggaatgaaactgcagcatgtggcgcctcacggggcaatgggaaaccagtgccagtacgatgaggagatatccacggcgatcgtagaggcagtggctgaattcgacaaggatctgatcatctactactgtgcaggcgcagtgctgggacagatcgccgagagcaaagggctgcgcacggcttctgaaatcttcgcggaccgggcatatatggatgacctgtccttggtgccaagaaagatggaaggctctatgatcacggatgaagaggttgcgatcagcagatgcgtccgtatgatcaaggaaggcaaggtgacttccattaacggcaaagaactggatattaagggagataccctctgcgtgcacggggacggcccgaaagcgctggcatttgtccagaagatccgggaaacgtttgcgaaagaaggcatcgagattaagcatttgtaggaaaacgatgcagaagcaccggagttaaatcaatgaatatatagttgaaggaatatcaacgttgattaattccggtgctttttgcagccttttttcctcaaaaatacataaagatgatgaaggagtgaaacaaaaaatgagtaaagaaactaccaaaaaagaaccaatgtccgtggtaaagaaaatgatgatcgccctggttggcggcttggtcgtaggcataggcttcctgctgctgcgccagcatctgacgacttcaggaaatgaagccgcatggacggttatcaacaaacttctcttccaggatatcacggtggaggaaggcgtcggggcggtcggcatcttctatatcgtaggccaggtattcatgagaggcctgcagctcgcgatcgtaccgctggttctggtgtccttaagccttgccatgtgcagcatttccaactccacgaaacttggaaggatcgccggacgtacgctggcaggattcttcagtttctatgtatgcggcgcatttcttggatgcgcggtagcgtatgcggtaaagtctcttggattcttcgatgtcacgctgccaagcgaggcagttacggaagcatccacgatcgatgcatttaatccgctggcgaccatcgtaaatgcagtgccatccaatattacggaggcattcagcaccaacaacagcattctggcggtcgtagtcgtggcgattatcatcggcctgtgcatgaacaagcttggagagaaagccgagccgttaaagaaagtgctggagagcggaaatgaagtaatccagatgtacctgaccttcctgatcaacaaagtagggcccatcgcaatcttctgcctgatctcccggacattcgcgatatacggcgtggaataccttgcgccggctgccgcttatgttgtgtcagcgatggtgacattgctcctgctggttgttacgctctatccagtcggcatatacttgacaacccggatgaatccgttcaagttcctgaagaagatcgcaaaagtcggcgtattcggattctccaccaattcttccgcagcatgcctgccgctaaataccaggacctgtattgatgaattgggatgcagcgatgaaattacaagtttcgtgcttccgacgggtatgaccatcaacatgaacggaaccaccgttatgcatatgtttgcagttacatttatcgcgacctccgcaggaatcaacgttacgcctgccaacctggttgtcatggcattcctgtccatctgcgcggcagcaggtacaccggccatcccaattgcgggaacaacgatgatcttcaccgtattatccggcatgggctggaccacggaagcctgcctgatcggatacgcattggtagtcgctatcaaccgcccggttgaaatggcgctgctaccactgaacgttatcggcgatgcagcgacgaacgtgatcgttaatgcgaaagaaaaagaactgaataaagaagtttacaacgggtaaaaaggaaagagatgacacgtaacatttttaagttatgcacgtaacaaaacttaaaaatgttacgtgttaactatatataaagggtgcgccaaactgacaaataccccgtgcaaaattgaaaatactggtgtgtcaaattgataatttaagtgaaataaatcatatcgtcgcaggaaaatttagttgctaggtcatttctgcaagattttatttggataaatatttctattaaacttaacaatcaattttgcacaggagtttttcaattttgcacggggtatttgtcgttttggcacaccagttatgtagggagttcacgtaacacttttgcattttgttacgtgtaaaagtgaaaaatgttacgtgtcctcttgtaacgcattccttgccggggggtctaataagaaagaccatacatgggaaggaggaagggaatggcggttatattgcgattgacatggcgttacatgaagcagaaccggaggcgcacgataatcaccacgctgggaatcgctctggcggtatgcgccttgacggcagtggtggtatttacatcttcgtttaccaggatatcaagagagatggtgattaaagacgagggtggctggcatgtgagattccaccaagtgacggaagcgcaggcaaaagaactggcagagtggaagaaggcaaaaaaaagttcgcctgccaaagactgcggcgagcatgcgggagaactgtgcatggatgtggaaatgcgccgtccgggcatagggacgctggcggccgcgcagaagtatgcaaaggaaatcggaatggaggaacttcccaagggggagtggagcgaattatccgaccatacgacagcgaagtatgaagtaagttatcacgacgaacttttgcaatactacggcgtattttctatgggaccagaaggcgtcggggctctgtctgtaaatatcctggttgtaattatcctgctatccagcgtttttatttacaacgcttttgcagtctctgcatttgaaaaaatgcgctatattggcatgcttggaagcgtgggcgccacaaggctgcagaaatctgcctgtatcctgctggagggggctctggaagggattgcaggaactattctcggaattgccacagggaggagcattacgggaaaggtaatagaggtggcagtaagagcattgagcgctagcgaaaatgtagccgtcgtgctgggaataaaagaactgcttatcatactgggatgctctgcgcttatcatcctggcgtcctgcacaattccatcttcccgggcggcaaacgcaacggtgattgacttgctgatccgcccttacccaccgaaactggatggtcaaagaaccacatctttgaaaagggaacacaagattatcggcgttgaaggagcaatcgcgctgaagaatatttttctaaaggaaaagcagtattctgcctgtattggaatcctaagccttagtctgtgcatcctgctgagcgggacggtggcgcttaagatacgcgcgggggattactatgtcaaggatctgcgggagcgtcccgagacagccatgtggacagaactggattgcagcggcgggaaaatgcaggaattctatgagaggctgaaaggattaaaggaagtgcaaagcatctctctgcaacgggcgcttgatttttcgggaatcctggtggatgaggccgatactgtttcgaaagattttagcgagatgcaagtaaaggacgaaaatggcagagtcgaaggcggcaatctggcggaagttacgatcattgggctggatgaacgaaccttctctgactatgcccaaaaagctggcatagaccaggagagggatgacggggaatccggatatcctgtcattctggaggactatatgatgggtatggagatatgggaagaagacgggcaggaaaaggatgtccggtacgaatatagcagccatctaaagaaaatggatcacgagaacttcaattttgtatatagcaaatacggcgatatgtacaattggggaatgaattacgactctgcaaaaaatcagttcgaaatagcaaaactgctggatggcagtttctacgtcttaggcaccacaaaagagacgccgccctatccttcttgtaaagaatatatggacgataccgaagaaaataatggattttatggcagcagtcggctcaaagcctatatgaaaatggaggattttgagagattcctggaggatccggcctaccaggatacctatggcagccatcccaaagaggcagcggtatccggcaacgatgagccgaaaaagatatcggcttgcatgacatttgacattgcgagggaatcttccggtaagaaatggtccaaaggggatgtccaatatcttcataaagatgtgaagatgcgtgcgcgggaagatcgggcatttcagcctaaggtatcacaggcagcaaaagattcagggatttcaggaaaggaatatatctttggaagcgccgccgtctacgaattggagaaaagccaatggtcacaaggatctattgtacagatcttgggatatggcgcgattgcgctgatcgtggcattttccctgactagcatattgcagaaaatatcaacatcaaccagaacaaggcggaaggaatttgcgatgctgctgtcaatgggaatgacgaagaagagcctgaagaagatgatagttatggagaactctatctatgggctgatgacaggaatactggggattccgttcagcattttcctgatgcatacccagttttcggaatatgcggggattgtaaaaaaggtgccttatcatctgatcgcgatggaattcgtaattgtaatcttgctgacggtatttccggccatatacggcatacggcagcttaggacggtgaaaatcatagatggcatacatgacgaggcctgctagaaaagatcaaaggagtaaaagagacaaggtaacccaatatggcataagttaggagggcatatggaaatattaagaatagagaatgtaacaaagacatatggggaaaaggacaccgccgtacatgccctggatcgggtttccttctctgtagaagaaggagaattcgtggcggtaacaggcccttccggttccgggaaatccaccctgctgcatattttgggcggtgtggataagccggatagtgggaccgtgcaggtgaaagggacggatattttccggttaaatgagacaaatcaggcgattttccgcagacgtcagatcggccttatctaccagttctataacctgattcctatattgacggtggaggaaaatatattgcttccgttgctcctggatgggaagaagcctaacccgaagaggctggcgcagattctttcgatcctggggctggaggatcggaaagaacatctgccaagccagctctcgggaggccagcagcagagagtatctgtgggcagagcgctgatcacgcatccggcagtcatcctggcggatgagcccaccggcaatctggaccagaagaatacgaaagaaataatggacctattctgcaagctgaacagaacatataagcagacgatcgtcatgatcacccatgatatgaggcttgcggcccagtgcgaccgggtgctcgcgatcgtggacgggagacttgcagctggacggacattaatgaatcagaaggtacctctggacaattgagtaaagaagaacagaggctgaacaggaggaatatgaatgaaagaaaggatatataaattattcctcaccctgctggtgagcctgtccctgggtgcgggtcccatagcccagcatgagatagccaggatgcttgagatgtttgtggaaacaggcgatgcgcagattcaagaacttgatgatgaagaaaatgagtccgaagaaataagaaagaagaaagattggtaatatatcgattcatagccaaaatacaaatggggtgtcgtacttatgtgataggtacggcaccccttaattttgcttaccattaaaaattctaatggaatccatagaatgtttaataattaacaagcggaagaagccaaacgcgtgccattaatttttctgatgataagaataagggatccggaatagttcaaacgaaacatgaaagatacaatcaagacaaggatcaaaagaaaactatcaaggaggtaaattatgtcaatatctgtagagtacgcaaacgaacacaaggattcaccggcagtgctttgctgcagggcagaagaaggcactgtgctgtcagctcataatctggaggatccggctatatttgatgatttggaggattccggcctgctcagtttagaaggagccttatcgatcggccaggttctgggagccaggctcacaaagacagcagattctctgacgcctgttactttagaacttgtggatcagattcaggagcaggaagaagaaacagagggaaaagaaaaagaagaggcatatgcgcaggatctatccgaagcggcggcccaggcagcctatccatattcgggaatccagggtgccaatacgctaaaactacatatcggagaagggaagggaattgatattgaacttccattaggaggctatcctactgcggacgtggcaacactttccaaaaaagcagcaacgcaagagaaggaaacagtggaaatggcagggaaggacatcctggcacatgaactgaccaaatacatcttcccaatccataaagtgattctcggaaatgagacgaagatcgaggatggcgtgcttacggtaagaaagacgctggaagaggacgcaaaaggcgcaagcccgattatcaaggatgtgaaggtagacctgatcacgccggataatcaggatgtctataccaacagcatgatggatatctgccctatcgcggtaaagaaagagggcaaattaggagaaggcgttacctacgaggccggaggcgtagtcgttatgctcaccggagtggaggaaagcggcaagcagtgctcagacgcggcttcatccgatggcattttcagcgagaaggtaatatttggacgtccgggggcgccggataaagatgacattgttatccgggtacatgtagtaatagaagatggataccagatggagcgcccaggcccgatggccgcgcacaaggccgcggatatactgacgcaggagatccgggaagcattgagggaactggatcaggagaaggcagcagaaaagcaggtgctggatgacatcaagcatatcggaaagccgagagtcctgtatgtaaaagaaatcatgggacagggggcaatgcatgacaacctgatccttccggaagagccatgcggatatgtaggggcgagacccaatgtggatcttggaaacgtgccggtatttttaagggtcaatgaggtacgcgacggcggcatccatgctttgacatgcattacgccggataccaaggagacaacaaggctgtactttagagagccaatcattgacctgctggctcatgatccgcagattcacttcctgggtgtgctttttgtcggaagcccgcaggcatgcacggaaaagttctatgtatccgagcgagttggagcagtagtggaatcgatgaacattgatggatgcattgtaagtacagaaggatttggcaataaccatgtagacttcgcctcccatatcgagcagatcggcaggcagggcatcccggtagtgggaacttcattctgcggaatccagggcgcgctggtagtaggcaataaatatatggacaccatggtagatatgtgcgtctccgaagatggatgggagactgataacctctgtgagaaccagatgactccggaagtggcgcagcgctgcgtagcaatgatgaagaataagatgatgggcagatcatttaaaaaggcggagaggcagtggagccaggcggttgccgattcgaatgcagaaaagatcaaggaggcgtagcagagatgctgatgattaatggaattaaggtgaataacgaggcggtactgtattcgggcgttattacagacgtaaatgagacggaagtcaccatcaggatcaccgcccgtatggggattatcaaaatgccgcttcgggcaatactgggaaatgagtatccaaagatcggggataaggtaacctggaagatgagtttgattgaaatggaaaatatgagtcaatatagggaggactaaggtatgcagctaactacttatgaagaactacaatcagaaatatttacgccgatcacgccggaggctgtctggacgccgcttaagaagccggtaaaagactgcgtcgtaggattcgcaagcgcatgcggcgtgcatctgaagacgcagattccatataagacatctggagacaggagctggagaaccgttcctaaagatgttttgccagatgaacttatgattacgcatggcggatacgatcacacagatgtcaacaaggatatcaactgcatgtggccataccagaggatgcaggaactggaagacgaaggattcattaagaaattctgcgacaacaatgccggattcatgggaggcggcggagacgtagaacttttaaaagagaagattggcccggagattgcggagatgtttaaagagcaaggaacggacattgttcttctcaccgcgggctgaggcacctgccaccgctctgcagtaacggtgcagagagcgattgaggcagccgggatatctacctgcattattgccgccctgcctcctgtgtgcaggcagcagggaactcccagggcgatcgcgcctacggtgcctatgggtgccaatgcaggcgagccgaataaccctgcgatgcagacgcagattgtcaaagaagcattaaagttcatggaggaagctgaccagccagggctgattaagccgctgccgatagaatatcacgcaaagatataagggaggaatgagacgtggcattaagaattattcagatagtcctgatcacttatgcggttgttgtcggaaccattattatcagggactttattaaaaacagggaaaaagatatgtccgtaaagatgcaggtcgcccattatatcctggggtttgtcgtcaatttctttgacgctctgggaatcggatcctttgctcctacatgcgcggcctatgcaggattcaaaatgattgatgatgaccggaaggttccgggaaccatgaatgcgggagtggcaatcccggtcatcttcgaagcgcttctattcatcaccgcggtagaagtgaaattgacgacgcttgtacctatggtgctctgcggcatcatcggatctttggtaggaacgagattccagacaaaagtatccgaacggatgatacagttcattctgggcttagccctgttccttggagcaatcctgatgcttggaagcaagctgggaatattgccgggaggcggaatggcagtaggactggtgggaacaaaactggtaattgcctgtatctgcaactttattctgggatttaccttatgctttggaatcggaaactatgcgccgtgcatgtgtatcgtatacttcctggggatgagtcctcttgtggcattcccgatcatgatgtgcagcggggctatggtatcgccaactactggaatcctgaatatcaaggcaggcaatgtaaaccgcaatgccattatgggaatggctgcaggcggcgttatcggagtggcaatagcggtctacatcgttaagtctatgcccatatccgtactgcaatggctggtgatcgcagtggttctgtactcttcggttacgatggtaatccgggccagcaagaacaaggctgcggcttgatcatggaagttccaaagcctgcttgcgtacgaagtcaatgaattttaaggttgccttggatgcatatttttcgtctcttacagcaatgccaagagaacggtaataatgctctttcagaggccggctgcatacatgattgctgacgctgtcgacaacaagacggggaagcagcgttatgccaaggccggtctcgaccattgcaagggatgcggcgtcgtcggatgataaatatttatggtggggatgaatccggttttcggaaaatattgccccaagatccgcatccagaccttcgccaggcatgatgaatgtctcggcgttcagaagcttcaagggaacgcaggccatacgggaaaagggatgatccattgggcatatcaccatatactcatctttatacaagggcgtaaaacaaaagtccctggcggtggttgaggacaggaagctgcagtttagatctcctttttttagcagagtgatcagatcattataattgccggagatcagctcaaattgaatgttgggatacaattcgttgaattccttcatgaactttggaagccaaaggatggaaacgctggtaaaggcgcccacgcggatggtgccggaatgcagcccgctgacgctgctgcttatctcctgaatccgctcttcctccttgatgatccgcttgatggaatcaatgattcttaagccgtcggcagtaggagagactccggatttcgaacgaataaagatggcaaagcccagttctttctcataattgttgatggcctggctgacagcggactgtgtgtagttcaaggattcagctgtcttggttatgtttcctgtctcatatgcttttaaaatgatctcatacttattcatacagcgctcctttgaggttagataataaaataacgaagttgttacgatgattctagcattttgcagtaaataatacaatgcaatatattattggaatatagtggaaggagtaaaaaaatgaacgtaatacctaatatagacctgtcaaactatgaacgggcctttactgttatagacacccacacgcagggagaatttaccagaatcgtgctcgatggcatgccgaagatcgaaggaagcacgatggtggagaaacgcaagtatcttcaggagcattatagtcacttaagagaggcgctgcttctggagccaagagggcataaggactgcttcggagcgattatcactgagccatgcgacccaagggccgattttggaattgtgtttatggagagcacgctctttactaacatgtgcggccatggcacgattggattttcaacggcagcgatcgaagcagggctggtagaagtcaaggagccgtatacctatctgacgctggaagcgccggcggggcttatagaagtaaaagttaaggtggagaataagaaagccgttgaagtcacgctgacgaatgtgccgtcatttgtctataaggaaggtctcaccatacggtcagaaggccgggacatccagtatgatatagcctttggcggacagttttttgccatgattgacgccgctcaatatggtatggaaatcaataataatacggtaaatgaatttattaagatcgggtatgacatcatccgcaggctgaaaacagatcccgccgcaaaggttcggcatccggaattggatattgcgagcattgacgcgattgaattttatggcaagccgggccgggaagatgcagatgtccgaaacgtggtcacattcggtcatctgcaggcggaccgctctccctgtgggacaggaacaagcgcgaaactggcatgcctgtacaaagccggtaagatagagattggccaggaactaaggaacgaaagtttcatgggtactatttttaaaggtagaatcaaagagatcacgaaggtgggcgaattcacggcagtagtgccggagattaccggaagcgccaacataaccggggtcggcaaatatatcatagatcaggatgatccgctaaaatatgggtttaccgtgggaatcggggattagcctacggtaaatggaatattgtcttgcatagcaggaagaaaggcaaaccgtctttcttcctgtcttctatttatagagtcacatattcgcaccatttagaatatatgctttcggatcacatcaaaggatgccggccctacatccagtacggccttgtggaaccgcttctgggtgaatccgtctccccacctatccatggcatcttttttcagttccaggaattccacatagccgatgtaatatttcaagtagttggcagggtccgcaatgatcaggtcatagatgtcttctatggtattcgtatccgtgatgccatagccgcggaagaaggagaccgtatctaacagcgtccatccgtcatagtggatgcccatgtccgccagcgcatacaggcccagaatgacggaggtattcttctgcatcagggttgcctgctccttggtaagcggcgtatagtagtagctcatcatctcgctgtaagtagcccagccttccgtatatccgccataattaagaagattgcggatggggtccggctttcggctcgcatagtagactgtctggtacagatggccgggatatccttcgtgggccagggttgtaaacaaagagatgtcgtcgggcatgtgtccctggttgatgtagatgacgttattcttggtactgtcgatggcaggcaccatgtagaatgcagggcttagatattcttccatagacttctgcacgtatttaatctgggtgctgacttcgggaggagcagggaatgagtccttaagccttccttccaggtctgccaatatggaggcaggatttgaatcttccagtatcgtgccctgggtcttgaagacatcggaggagatagaggaaccctgtgtggaagcagccagcacggtctgcatggctttcaggtcatccagcatctgtgcctgcgtcagctgctgaagctgggggatcgtacggctggagccggtttcgcttgcaacgacgttttcatagtattcacgcccctttggcagatagcacagtccgttattgttcttgccgctggtgcgcaaggcagccaggccattttttaacaggctgtaggagggaaagatagactctttgatggcggaagagttcttctcgatgtaggacgcctgctcttccgctgtcagttttaaggacttcagacgttcctcaaaggaggaatacaggtagttctcatctcccatatcgataaaggcctgacattccttcataatatcgtcggcagaataggaggccataaaaagcccggcctcggacttggccttctcgaattcaatgatggactggaagtactcgggcgtcttggacagcagttttaaatatgtatcgacatcagagacgtcgtagaactgatactctgataaaagcaccggaagctgggactgggtaccggtaagcggagccaggggctcgtcgtacagagagaatttggcttcctttaccgaagaagagagatagtcttccagtacatcataagtgagcttgttcttggaggaaagttctttgcggtcgtaagactgaagcagcgccagcgcgttttccacagaagcgcatatggctgaagtatccgtgctgcaagcgccatatgtgacgggggtatctttgatcccataggcagaaggatcctttaaggtatagtggagggtgatcgtgcttccggatacctcctggcaaaacagggatcttgtatagttttcaaagcgctggtcttcatcctggtgaaaatgccggaagactcctacagataggaaaatggctgctaagaagagagatgctatgatggcagaacgtttttttgacatagtggtccttgaggtttttttacatttatatgccgataaaacaggtatcatgccgggaagccatagaattcctgccagtcctgtgataagattaagaattaagagatggtatgggggtgacgatatgctgcacatatccatatgcgacgacgagcagatggcagcagagaggatacaaggactgatcgagaaggaacttaaggaacagagaattgcatatcagatggatctgttcaaaaatggggaagaatttctcagccagtatcagatccgcagcgaggaactgatttttctggatatagacatgcctgtcaagtcagggatagaggtcattgaagaattagaagaggtcggaaagaacaaggatgtgatcctgattacaagccacgaccatctggtgctaaagtcccttacctatgggccgtttcagatcatccggaagatgagcatggcagaagatattccaaaggctgtccggcgatatctccgggagaagaagcaggaagatatggtcatagaatttgcgggaaaaggatttgtccggcatgtgaaaaaggaagatattgtctacctggaaaagtacaggcacaatattaccgttcatctaaagaacagagagaatctgtctatccggggaaatatgcaggattacgaaattatgcttgccagacagggatttgtcaggattcatctggggtatatcgtaaacctgcggcaatgctattctatagaaaaaagcgagatgatcatgacagacggagccaggctccccatcagccgggaacgtcacaaggcagtcaaagagcagtttatgatcagcaggagaaattaatatgaatcagggtatgctattcattggagaggctgcgaatataatagagacaggaatcgtggtatattttctcacccggtgctttccttggaaggagaagtatacaagccccagagtgctctcggcaatactgtggatcatactgtttgcgctaagccagttaaatggatattttgtttacagccattatctggtgatcctggcggatatcgttctggtttttgtatttacagggatctttatgcaaggggacatccatctgaagctgctggggtgcctattaccctttctgacggtgagcatcatcaacattctggtgatgcagacattggcagtcttaaatttccagccagcagggaagttcatggctagttatacgattcccttctgtataggggcagtgttatccaaacttctgctctggcttatgctaagcaaggtcagcgcggtgatacaggatgagaatctatatctgtcgaagcggtattatgccattatcaatgtactgatggcatcggcaatgggaattgaatttttccttcattatgtaagcaatacctatctgtatgacctggctgccagcaggctgatgcttgcggcggctgtaggattcgcgctgatctgcctgtacattggctactccatcttccgcatcgggcagcagaacagccagctgttaagatatgagctgcagcagtttaagagccgggaaaatgaacgccagatccaggaagcagagcgggccggacttagaattcgccagctccaccatgactataagaatcattgcctgaatatgcagcagctgctggataagaagcagtatgcggaacttgaggactatctacagaaacttacgggaagatacctcactcagaaccaggactgcgtggatacgcataatgcggtgctggatgctgtgatcaacacgaagatactggagtgcagggaggcggggatccaatttggctgctttgtcaccggagacgtaagcaaagtaacaggccttaagctggggatcatcttgttcaatttgctggataatgcgatagaagcaagcagggaggaagcgtgcaggaaaagaatcgagcttcggatagagaaagataaggacgtgctgaatattaccattaagaatgatattgtagattccgttctaaaggacaatcctacgcttgagacgaataagccccataaagacctgcatggcatcggccatttgacggtagaagagatggtggcggaggcccagggcatggtagaatactatgaggaagaagaccggttctgcgtccatgtattcctgccggttcgtaacagctgagtcaaagaagatggcaaagcgtgccgtttcagcagctttttaagccgaggatattgagcagccgcagaaatttggtaaaattgtcataggaatgcgaatcctttgagaagaaatgacattccggagggaggatgtatgatgaaaaatatgaaaagatggctggcggcagcgcttgccgttatgctgtgcttaagcctggcagcctgcaaaggaaaggactttgacgcgaaaggctatgtaaagagcgtgctggatgcgcactatcacggagagtataaggactacgcgaaatatctggatatctctgaggaagaggcaaaagccgatctcgacaaggatgtggaccagcagatcgatcaggaggttgccgctatcattgacctgggtgatgaaggcaaggccagatacaaggagatgcttgaaaaagttgagaagctggcaaaatatgaagtgaaagatgccaagaagcaggacaatggcaactacgtagtgaccgtggaagtagagccttccaatatataccagacgctggagcagaattccacttccgtgacggaagagaaagtgaatcagggactgatgccgtcagacccggcagtatttactgatatcctggttgaaagcatccagaagagcattgacggcaatacatatggagatgcgacgacggtcgaggtaaacgtgacaaaggatgacaacggcgcctatggcctggaagaatccgaagtgcagaaactggcagacgcattatttccacaatagagaatagaatatgtgacgataaccagaggatatttcccggacttgcgcgatgggggatatcctctttcattttaccgttaatggcctataataagccggttcattcatatacattccaggaaaaatatggtatagtagaactatatttacttaagcattttcttttgaagatgcggaagagaggtaaggcatggaggggatgaaacaattctttctgaatcttggagcatatgccggacccatcattattctattagcagaaatactcattgcggggatccttctaggctgctttgcgctcttaagccggaaaaggaaggaaaagagaagagaatgggagggcgagcatctttactatacagcgatctcccaagggcagcaggaggtgcatgtcctaatcaggcgggaagatttctgcccgatattcattacagataacttcgagaatatgatgcatatagataaggaacggttcctgggagatgtagaagtccttaatggcatgacggatcgtaagacagggaaggaattctggagttcttatggaagctgggatggaaaaagcgtgctaaacagggaatttcgtgtgaatggaagagagcagtggctgggattaagcgtgtcacggctaagcgaccagaagcacgatttgtttgtgttccgggatatcacggaagagaaggagcggttcaaggaactggagcaaaggcttcaggaggcggaagatgccagcaagtataagacgaccttcctgtctaagatgtcccacgaaatccgcacgccgatgaatggaatcatcggcatgatggcccttgcccagagccagttaaaagaggatagccctgcgaagccgtatctttgcaaggcggaggaagtctcccaatatatgctgtctttgatcaatgatatcctggatatgtccagaatcgaggctggcaagattgaattggaagaaaaggcgtttgacttaagggaacttggggacaagctgcgtgtcatgttccagaagaatgtggaggcaaaaggcgtccattttgcattggagtttgtggattttgacgtgaactttgtaataggagatgaactgagaatatcgcagatcctcattaatttcctgtcaaattccgtaaaatttaccagcgagggcgagattagggtaacgttccgccagatgcttaaggaagacggaaggatagatttgatggtgcgcgtccatgatacgggaattggaatggagccggaattcatcagcaggatattccgtccctttgagcaggagagcgcggatattatcaagaaatatggaggctccggccttggcatggcaatcgccgatcagatggtgcgcctgatggacggcgagatcgtcatagacagcatgccaggacagggctctgattttatggtatttttgaatcttccgatcgcagatgaacaggaagcggaagcaaaggatgaagaagaggcggcgcagacggaagattcggaagacttttcctatgagggccttaatatccttatggctgaggataatgagatgaatgcagagattgcggtaggcattcttgagatgagaggcgcccaggtggatgtggcagctaacggccgggaagcggtagagaagttcgccagcaatccgccgggacactatgacttgatcctgatggatattcagatgccagagatggatggccgggaagccacgaaaaccatccggtcaatacagaggccggatgcaaaagaaattctcatattcgcgctttccgcggacgcattcgtggaggaccagcggtattcagcggaaatagggatgaacggccatttcgcgaagccgattgactttgaagccatgcgtgtaagcataggcaggattatgaaagagagaaagcagatatgaagcgaagcagtctgtggggatggataacaggaaaggcagccttaaaaagaatcatagccgcaggcgcggtgatcgttggcctgcccatcatctggcatagttaccagaacggcggaatattcgacccggatagttatgcgaaaaaccaaaaagtacaggataaccaggttattttcccggaggaggatgagtacagccaggaagacggcgggaagggagacagcgatctgtgggagaaagaccacaaggcagaagagaaactgaacccggaagatatgccggactcctccatcctgtttgaaacgaagggaaaactggcggaatttggaagcgccgatcagatgacctctgatgcgaaccagccaggaggcattcccggaagcccggacggagatgacgggccgacgatcctggttccgggaggggacgggagtatcacagtacctgacggaacatttgggccagatgggaaccacaatgggaacggatccgaaggaaacggaggcggggatgattcccatccatccgtggatcctgatcccattattccagacccggatcccaggccggaactgccgcccgacatctatgaaggattaattccggtagagacatttccggatggaggaatatcaggggacggcagcaatgtgaagattaccttaaggctcactgaggatatatatgagacaaaccctatctattacggggaggtactggatgactggaagctgttctgtgctgtctgcgtctatgtggatgtggatagcggggaaggcatgtcaacaatataccggatagaagactataatgagaactttaaaatcggaagttttcccaaggtggctaaggaagacttttccgttgatttttactttcggccaaataaaggaagcaaatggcagaaggaaacctggaattataaggtaaagccattcaaagtcatgttcagcggatgggaagagggaacctattcatcaccggcatggtatccacagatcggagagaccaggaatctactgaattactatccggacgtacttccagaagagtgggtggatatctggtcccttcccattgacctgccggaaatgttcccgggatggtcggagacgccgcagggcgagccggtaccgctgatatacaatccggtgcttccgggacgtcatgtgctgtatcctctggaattggttccggtaccggaaggaatgagcgtcagtatggaaatgaactggaactattggatgtgcctgcagacgctgaatgaatataccggcagcagggagatgctggatgtgccggatggtattggaatgattgacctgtatggggtaagcgtggatgcgatcaagattcccagttccgtgctggaagtgaacctggatgcttttgggctggaggttagccagtcttaccaagtggatgaggagaatcctaattacgcttcctttgaaggcatgcttcttaacaaagataagacggtcctatatgcggtaccgttagaaaagaagacggttaccgtaccggaaaccgtgacatatgcggagatatccaataatgcgattgaagagatgcattttcagtccggcacgccaatcaaactggaacttgaaaaccttcacgatgcgtctctatatgttccggcggaggcgtatttcacgtatcttgcagcctggggagaccggcttggaagcaacaggcttcttccggataatggcgctgatgcagagtttattatccaagacggggcgatcttatctagagatggcaagattctgtacgggctgctggattctgtgggtggcatctatgcggttccggacaaagtggagtacatagaggaaggagcatttgcaggcagcgccagcctgtctacagttatcctgccagatagcgtgaagtctctgaatgcccaggcaatgacgggcagacagatatcctgtattatctgcctgggagctgagccgcctgctattaagggggacagttttgataatctggacgttcttcaagtacaggttcccaaaggagccagagaatcttatgtggatgcgtggacacaggcgctgggcagggagaaggctgaggcgatcgtgacggaggcgttcaatcagatggagagcaaggatggatatacttatctgacgcaggaagatggggcggttcttctgaaagtgccggaggatctggtgtactttaacggaaatgaattgcaggatgttacgatcaaggagattggaagcaacgtattttccaattgcggacagctgctggtggcagaactgccaaaaagcgtcaaaagaattggcgagggcgcatttgaaaaatgtagagaaatccagggtattgtaagttattccaccgatacggtgaccgtgggagagaatgcatttgcaggctgcagcaagttaaggttcctggcattcaatgctgcttcggccacctttgaaaatgaatattggccaggaggaggcatgaaatactgcgtaccggagggggcaagcggatataacggcaatcatgtgcagtcaggctgcgcttcatatttcctggaaagccagaatgaaggccggctgctttatggaaaggatgaagaaggcaggtatctgctagccgctaccgataatattacaggagaggtgctgttgctgcccgataccttggagattgacgacgaagccatgtctggctgcggtgaatcatttaccttagattcggcagggatggcaaggctgcgctatataggggattttgccttcatggattccggggtgaccggggatatcatacttccagatacgctaagatatctcggcggttatacgttctatggatgtacaggcatctcatccatccatatagatggccctcttgactggtacaagaatgaatttcatggcccggaacttagaagctgcgtattttcggggtgtacaaatctggaaacagtgacctttggaagcgaatgcggagtgaaaacgatcggagaagaagcattctggaatacggcgctgaagtctatcgaccttccggaaggagtcacaggccttctttcaggcgcgtttggctgtacacaattgacagagatcaagattcccgcaaatatggaaaatatatattactccgtctttgatagctgctcgaaacttaaaaaagtagagtttagcagtgacattccgccaagcctgatcctatatggggtaggatatggatatctctttggcatggatctgccggatgacttccgtattgtgctatcaggaaatgcggctggaaaagaggaagcctatattgaggcatggaaatatgctatgataggctacggagcggatgatcagaatgaactgtcgcaagaccagataagagaaggcgagaatatcgtgcggagactgctggggcttgaggcagcgcgcattgaggcggctcctgcaccggtagcgccggatgccatgccagcgcaggaagaagagaacgagagcgaagatgccgggggcgagccgcagattgacgatgtacaagacaaggcggaagatgccgggaccggcgatgagaacgccgggacagatgcagatgccgaccatgcagagccggagtccggcaaggcagagaatgagggggaagaagagttatgattatcgaacagtcggaacatattgtccgggaagtcaggaaggcttttatcggaaaagacgagattataaagaaggtgctgatgacgatatacgccggaggccacattcttctggaagattctccgggggtgggaaagaccactctggcgctggcgttttccagagccattggactggattataagagaatccagtttacgacggatacgcttccgtcggatattaccgggtttactatgttcaaccggcaggccaatgagtttgtatatcatgaaggcgcggcaaactgcaaccttctgctggcggatgagatcaaccgtacttcgccgaagacgcaggcagcccttctggaggccatggaggagaataatgttaccgtagatggagtgacccatatgctgccttcgccgtttatctgcatcgcgactcagaacccttttggaacgtcaggcacccagcccctaccggagtctcagatggaccgtttcatgacaaggctgtctatcggatatccgtcagccgaagatcagatgcagatcctgaaggcgcaccggtacgccaacccgctggaagacattcaggtggtggcaaccagagaaaatatcctggaggtcaggaattatctgtcctccgtgcggctaaatgatgatatgctccgctatattataaaactgtgtgaagagacccggcagcttccactggtggaactgggcatcagtccccgtggagtgcaggcgttgacgaggatgtccaaggcccatgcgattctgcatgaaagaggctatgttgttccggaagacgtgcaggccgtctttgtagacgtgtgtgcccatcgtctggtgctgaggcctcaggccagggtagaaggcgtgacggagcgtgatcttttggcggatatcctcaaaagattccaggcgcctgcaatgaataagaggtggaagaatgaataaaagccggaagatatatgggagtatctttctcttctcccttttcatcctccttctgtccggcagccggtatgtcttagcggcagtggcagcagaggccgcccttttgctcttgctaaggatacttctgtctgttgatgcaaaaggcatccagctaatgcagaaaatgcaaacggcatgcgttgccggacaggaactggagatatctatggaggcactttcgaaaaggcggcttagggcagccggaattttggaagttactatggcataccgtaatgtgctgtttgggtttacagggaggcagcagattcagattccccttgcaggcagacaggaatcctttctgataccgtttggctctgaactgtgcggggaagtgcatgtgaaggtagaaaaggctgtctgctatgaccttttcggcctgtgcagggcggaattggaatgtccgggcgagcagatgctgacggtgcatcccgggaaggtgccgatacgcctgctgctcaagcggcagccccagggatatctggaaggggaacagtattatcagagccggaagggcaatgatgtaagcgaggtctttgacttgagggaatattacccgggagatgacatccgctcaattcactggaaactgtccagcaagatggattctgtgattgtcagggaaggaagcgacacgtcccattatgatacgattcttctatttgatgccgggcttggaggcaaagagaagcagtgggataagaaagtattgtcatctgccgtagaactggggatctctgtaagcggcaggctaattgagctgggaataccccattatataggaataccggcaggggacaggattttgcggcttcaagtgtcagatcgtgcggattatctgcagatgatagatatctggatggggatcactcttccaaagaagagcggaatagtactccagaactttctgattgagaaaatgcagaaggagtatacaaagcttatctatgttgcggtgggagaatattcggaagaattattccagatggaaggggaactggacatgacagcaatatgcctgcaggagaacggcgatcaggtgggactgacgcagagaggctcaagccagctggtggaacttccctatgatctgctgtacagccatcctcataatatatctatataacaagaatccttcctcaaaggatcatgaagggtagcaaaggagagacattaagatgcgcatgcgaaaccaggaggatgcggtaaaaagaatagaactgaaaagcgcatccaagagcacgcaggcagaaggactgtggcagtttctcctggcggcgcttcttttgataggaatgcttagatcctacctggactgcgtgacgcttagcggaatgcacgcgtggatactttctgttgcaggaggcgctgcgcttctgtgctgcgccgtattatcatcttacccaaggacaagcgcatatgcaacgcttccgcctgtggcggccggagtgatctggactgtcatatccgggatcagggaggtatatggcggctttctgggagtgatgaattatctgatcagctggtggaatctaagatatgatgacgggaagaatctgtttcagggagaaacgatcactcagcaaggaatagaggcattttccgtagtaatgatcctagcggttacggcggtcgtgtgggagatggtgcaaaaaaggaggagcgtcctgtccggaattcttttgatgctatttctggctcctggcctcatattaggctatttgtctacagtgactgcctccattttgctgacggccggggtcgggatgtggcttcaccggattcagggaggcaggcagttgcagagaggattgtggacagctggcctgggaatcctattctttgccttagcggtttgcgtaggaggagaaagcctgaagggaatcgagcatttccgcaaggaaagcgcccgtcagatccgggacatgcggtttggcgaagattcgctgccggaaggcaatatgtatagggcggattctatgcttgacggggatgaggagacattggaggttgcaacaaggcaagtgaagtccatgtatcttcgcggcttcgtagggggctgctatgaagaagggatctggacgccgcttaagaattccgcgtttggcggagaaaatgcgggaatgatgggatggctcaagaaacaggggttctatacagcaagccagtatttcgcctatgccagtataaaagagcaggaggagattccgaagaaccaggtagagattaaaaatatcggcgcgcgcagaaactatatttacatgccttattccgcacaaaggccgaagaagacgcaggctcatcaggagcaggatgcgaatttccagtcatccagcttccttggaagcagggagtatgcctattcagagcggtcagaaaatattccggcagaattgcttcatgtatcaggctgggtgtccagcccttccgggaaagaagaaaaagcctaccaggaagaggaagcagtctatcgcagtttcgtgtacgagaattatctggacgtggatgattccctggtgggcctgatggacttcctgttctgggccgatgcaaagccggaggagaaggatggcatctatacgtctaccgacaggatacggaccattttaagagaaatgacatcttataaagcgaatccggaagcagtgccggaaggagaagagcccgtgcgctggtttcttacggaagggcggcagggaaatgcggcgctatatgccaccactgcggtgcaggcgtatcgtgcaaacgggataccggccaggtatgcggaaggctatctgcttaaggaagcggaagtggcggattccaagaatggaaaagtcacgcttaccagccaggacagccatgcctgggcggaagtctatatggatggcatcggctgggtcccgattgatgtgacgccgggattctattatgatacatatgcgttgatggaaatggtacagaagcctcagggaatccagcagacggctgccgtggaagatacggaaaatgatgcggatcaggttaatgacaaaggtcagaaagggacggaggaggaaaaggacaagacttccgaaaccattcttcaggctgtgctgggggcaggggtcatggtgctgatcgttataacggctctgatcatatttttggagagccggcgctatctatgtctgaggagactggctcggaattaccgggatgccggggaggaaggcaaggcgcgcattctgtgccatgcagtcatcgaatttctgcgtatggctgggatagaagcaattcccgggtggcaggcggaggagacggaacaggcattgacggaacttgtgccggcctttcaggagggagaatacattagggtcagccatctgatagaaaagcatatctatggagacgaggaattgcgggcacatgagaagagagccctggctagcttcattgaaaagatgaacagggagaggaagagattaaaactgcaaaggcggcttcgcattcgctattgcagatggcgcataaagcaaaagatataggcgcaatcccttgacagttcgggctatgttatgctacgatttttaatacgaattatatgcaaacgcagtgacgaagagagtacgtggtaggaagtcctacagagaagtccccggattccggacaggaacaggctgagagggatgggcgaaatacggcggaagatggcttccaagcggtgcagtcgataggctacatatagttagtccaggtaggctgcaaagggtccgccctttaacgcggtagggtgtatcttaatgcacctgctaaggcttcctgccgcgaggcagaagcgaacagaagtggtaacgcgggttagtctcgtcttctccgatttttcttatcaagaagaatcggagatttttttcttcatggagaactgcagcgtgtgcatatatcagcaaagaggacaaggagaggattagaaatggataaacagaagtactatattacgacagccattgcttatacatcggggaagccgcacattgggaacacgtatgagatcgtgcttgcggatgcgatcgccagatataagagaagccaggggtacgatgtattcttccagaccggcacggacgagcatgggcagaagatcgagttgaaggcagaagaggcaggggttacgccaaaagaatttgtagatggagttgccggacagattcagacgatctgggatctgatgaatacgtcctatgacaaatttatccgtaccacggacgctgaccatgaaaagcaggttcagaagatatttaagaaattatatgaccagggggatatttacaaaggatattacgagggaatgtactgcacgccctgcgagtccttctttaccgagtcccagctggtggacggcaagtgtcctgactgcggccgcgaagtgcagccggcaaaggaagaagcgtacttctttaagatgagcaaatacgcggatcgtctgatcgagcatattaacagccatccggaatttatccagccggtatcaaggaagaatgagatgatgaacaacttcctgcttccgggactgcaggatctgtgcgtatccaggacatccttcaaatggggaatcccggtagacttcgatccggagcatgtggtatacgtgtggctggacgcgctgaccaactacatcacgggcatcggctacgactgtgatggagagagcacggagcagttcaagaaggactggccggcggatctgcacctgatcggaaaggatatcatccgcttccataccatttactggccaatcttcttgatggcgctggatctgccgcttccaaagcagatattcggccacccgtggctattacaaggcgacggcaagatgagcaaatccaagggaaacgtactctatgcggatgaactggtagacttcttcggcgtagacgcggtgcgttacttcgtgcttcatgagatgccatttgaaaatgacggcgtgatctcctgggaacttatggtggagcgcatgaattcagatcttgccaataccttgggcaacctggtgaaccggaccatctccatgaccaacaagtattttgacggcgctgtcacggataagaaagtggcggatgacgaggacgcaaaggccgtggacgcagaccttaaggcggtcacggagaatacgccaaaggccgtggaggctaagatggatgaactacgggtagcggacgccatcacagagattttcaatctgttcaaacgctgcaacaaatatatagacgagaccatgccatgggcgctggcgaaagacgagtctaaaaaagaccgcctggagacggtgctttacaacctgctggaaagcatcaaggcaggtgccgtactgctggaatccttcatgccagacacctccgctaagattctggcgcagttgggcgacggcaaagtaaccgataagccggagattctctttgcaagacttgacatagacgaagtcatgaagaaggtagaagaactccatcctccggttgctgaagaagcagcagaggaagaagtcattgatatcgaggcaaagccagagattatatttgaagaattcggcaagatgcagttccaggtgggcgagatcatcgcctgcgaggaagtgaagaagtcaaagaagctgctgtgttcccaggtgaaagtgggaagccaggtgaagcagatcgtatccggaatcaaggcgcattactccgcagaagagatggtcggcaagaaagtcatggtgcttgtgaaccttaagccggcaaaactggcaggagtattatccgaaggaatgctgctgtgcgcggaagacgcagaaggcaatctggcgctgatgaccccggaaaaagaaatgccggctggcgcacagatcagttaaaatcttcaaacaataacaaaaagggacaggatatgatgcaaagtgacacgtaacactttttaaaagtgttacgtgtcaaattaacaaaggagatgaagaatatggataaaatcagaattggtatcgtgggatatggcaacattggcagaggcgtggagaaggccatcgcccgcaacgaggatatggaactgacggctgtatttacgagaagagacccttcaggcgtaaagattgcaaccgagggcgttgaggtaaagcatatcgatgacatgttatccatgaaggataaaattgatgtgatgatgctctgcggaggctctgcgacggatcttccggtaatggggccccagatcgtccagaattttaatacaattgacagttttgatacccatgccagaatcccggaatattttgcaaatgtggataaagcggcaaaatccggtggacatgtaggaatcatctctgtgggctgggatccgggaatgttctcgttaaaccgcctgtatgcagagtccatcctggtacagggaagcacctatacattctggggaaagggcgtaagccagggacattctgacgccatccggcgcgtggaaggcgtaaagaatgccatccagtataccgtgccggttgaggacgccgtggaacgcgtaaggagtggaagcgagccgcagcttaccacaagggacaagcatctgcgggaatgctatgtagtgccggaagaaggggcagaccttaagaagattgaagagaccatcaagacaatgccgaattattttgatgattatgatacgacggttacctttatcacagaggaagagctgaaagagaaccacagcaagatgcctcatggcggatttgtaatccgaagcggcgagacggggacggatggaagcaagcatattatcgaatattccctgaaactggattctaatccagaattcacggccagcgtgctcgtgtgctatgcaagagctgcctatcgtctggcgaaggcaggcgagacaggggcaaagacggtattcgatatcgctccggcgcttttatctatgaagacgccggaacagttgcgcgccgagttgctgtaacagcaggtttggaggagacatgatattcgagacacatgcacattatgatgacgagcaatttgatgaggaccgcagggaactcctggaatccatggcagcgggaggcgtaggcacgatcgtaaatgtaagcgctacttatgaatcctgccaaaaggtagtagatatggtccgggaatatcccttcatgtatgctgctgtgggcgtccacccggataatgtgggcagcctgaatgaagagacgtttgcaagcatgaaggagttattccggaaggataaggtagtggcggttggcgagatcggccttgactattattgggacaacgagtcccatgagacgcagaaggaatggtttgtccgccagctggacttggccagggaactggatcttccggtcctgatccacagccgggacgcggcggcagatacgatgcagattatgaaagagcacgcacaagggcttaaaggcgtgatccactgctactcctactccagggaaatggcaaaggagtatgtgaagatgggcttctacatcggagtaggcggagtcgttacgttcaaaaacggaagaaggcttaaggaaacggtggaagcgataccgctggaatccatccttcttgagacggattgtccatatcttgcgcccgagccgtttagaggcaaacgcaataactctatgtatatcaagtatgtggcagaggagattgcagggctgaaaggaacgacttatgaagaggtcgtggcgcagacggaggaaaatgccaggaaaatgtatcgcttataaatcattaaaaaatcagaaagcggatggctctttatgccatccgtttcatcatcaacagcgggtcagaggaccggcggctgtctctgaaaattcatattttcttaatattattttattttttttgtatatcataaaagcccagagtattgtataataatgaatattacacaggactgggggagtaaagtttcatgagcaggccgactttggggaatccgcagaataccatcgagatcttacagaaatatcagtttacatttcagaaaaaattcggtcagaacttcttaattgatacccacgtattagacaaaattatccgtgccgctgacatcggcaaagaagacatggtgctggagatagggccaggcattggtacgatgacgcagtatctggcagaagcagcgggaaaggtgatcgcagtagagattgacaagaatttgatacccattctatccgatacgctaagcgggtatgagaatgtgcagattatcaatgaggatgtactaaaactggatattcaaaggcttgtggaggaagaaaatgccgggcggccgatcaaggtcgtggccaacctcccttattatattacgactccgattattatggggctatttgagagccatgtgccgcttcacagcgttaccgtcatggtgcagaaggaagtggcggaccgtatgcagacagggccgggcaacaaggattacggcgcgctgtcattggcgatccagtattatgccgagccttatattgtggcgaatgtgccgcccaactgctttatgccaaggccgaaggtggggtctgcggtgatacggcttacacggcatgaaaagccgccggtggaagtagaagatgaaagactgctatttgatataatccgagcatcctttaaccagcggcgcaagacgctggcgaatgggctgaacaactcggacaggctggatattcccaaggaggcgatcacagaagccatccagcagctgggaaaggggccgtccgtcaggggagagacgctgacgcttgaagaatttgcaaagttaagcaatagtttgtggcaatatatgcagtagggctattgactttactataataacctgaaacacaacaacgaacagaaaggatgatgactatggcgacaaagagagagtatgcattgtttgagatcacaccggagattgagcatttcgcccaactttgcgaagacaataatgcaattgataaggagctgtacacgaagtacgaggtaaagaggggcctgcgtgatgtgaacggcaagggcgtcctggccggacttacgaatatatcagacgtatgcgccaccaagatcgaagatggcaaggaagtcccgtgcgcaggcaacttatactaccgtggctacaatatcaaggatctggtacagggatttttaaaagatgaacattacggattcgaagagatcgcatatcttttactgttcggagaactgccgaatgagaaggaactgtctatgttccatgagacgctggtagaacggcgcacgctgccgcctacatttgtaagagacgtaatcatgaaggcgccaagccgggacatgatgaacagcctgtcccgctccatattgaatctgtatacttatgacgccaaagcggacgacacatccataccgaatgtgctgcgccagtgcttgaacctgatcagccagtttccgatgctgatggtctatggataccacgcatataattaccgtatgggggatgatctgtttatctatgcgccgtccccggaactgtccacagcagagaatatcttgatgatgctcagggaagaccgcaagtatacgaagctggaagctaagatcctggacatggccctcgtgcttcacatggatcatggcggcggtaataactccacgtttaccacccatgtcgtcacgtcatccggcaccgatacatattccactattgccgcggccatggcgtcccttaaggggccaaagcacggcggtgcgaacatcaaggtaactcagatgtttgaagacatgaaggaaaatctttctgactgggaagacaaagatgaagtgcgcaagtatctgaacgacttgctggagaaaaaggcatttgacaagaaggggctgatctatggaatgggccatgcgatctactccgtatctgacccaagagctgatatcttcaaagtgttcgtaaagcagttggcgaaggaaaagggatacgaaaaagaatacgccctgtatgagatggtggagcatatggctccggaagtgattgctgagaaacgcaagatatataaaggcgtgaatgctaatgtagacttttacagcggactggtatacggcatgctggatctgccgccgtcattatacacgccgatattcgcggcagcgcgtattgtaggatggagcgcccacaggctggaagagttaaagaacgtagacaagatcatacgtccggcttataagccgctggcggcccacagagattatatcagaatggaagacagatagatggaaaatgagttttactacccctccagagatggcaagacccagatccacgcgatggaatgggtgccggagggagagataaaaggcgtgctgcagatctgccacggcatggtcgaatatataaagaggtaccgggaactgggcgaatatctggcagaacgcgggtattatgtgaccggccatgaccatctgggacacgggcagtctgtgcaaagcgaagccgattatggatattttgatgagacaaaaggcaaccagtatgtaataggcgacatacataggctgagggagattacgatggagaaattcccggatgcgccttattacatgctggggcacagcatgggttcgttcctgctcaggcagtacctgaccttatatggcaaagggctggctggagccattgtcatgggaaccggctatcagggcacgctgatactttcggctggacagtgcatctgccgtattatcgctgcgttcaagggatggaaataccggagcaagttcgtagaccggcttagtttcggcggatataacaagagattcgagcctggagagacttccaaggaatggatcaccagcgataaggaaaggtgccggaagtacgcggaggatcctctgtgctccttcatgtttaccttaggcgcatattatcagatgtttgaagggatgatggcgctgaccagggacgaaagcatggagcacattccaaaagaccttcctatgctgtttgtgtccggcaaggacgatccggtaggcggatttggcaaaggcgtagaaaaggtattcgccaagtataaagacgccggaatgcagaagatatctatgcatctgtatgagggtgaccggcatgagatattaaacgagacagaccgggaacaggtgtatgatgacctgttccagtggatggaagatcagaaaggagcgcggcaattttaaggtgccgcgctcctttgaccgaaaaaaataaggcgtccatggggatgattcgaatttttttcgaaaatgtgatgaaacattgacaatgaataattgaaagaatagaataaactcaaaatataagggtacacagacaaaggcgtcggaactttgtctgcgtgccttttttttgttgcataaactatgaatttggaggaagaaaagatgaaaacattgggctattataacggtaaatttggcgaacttgaggacatgagcattccgatgaacgaccgcgtatgctggtttggcgacggcgtctatgacgcagggccgtccagaaattataagatattcgcgatggatgaacatgtagacagattctttaacagcgcaggcctgttagacataaagatgccgatgtcgaaggaagaattaaaggcgctcctgcaggagatggtagacaagatggatacgggaaacctgtttgtatactaccaggcaaccagggggacaggaatccgcaatcacgcatatacaaaaggaccggccaacctgtggatcatgctgaagccggcagagatatccgacggaaaagaacctataaaattgattacctgcgaagatacaagattcctacactgcaacataaagaccttgaatctgattccttccgtggtggcgacgcagaaagcccaggatgccggatgccaggaggcagtattctaccgtgcaggagggcgggtgacagaatgcgcgcatagcaatgtacatattatccaggacggcaaacttgtgacagccccaaccgataacctgattcttccgggaatcgcgagagcgcatatcatcaaagcctgcaagaaactcggaattccggtaagcgagacgccatatacgctggatgatctttttaaagcggaagaagtaatcgtatcaagttccagcaatctctgcttgtatgccaatgagattgacggcagggcggtaggcggaaagaatccggaattgctggagaacatccgcagcgaagtactgaatgaattttatgaggctacagaagcagaataacagacggaagggtgaagtcatgggagagattagatttatggcggcaggagacagggctatggtggcggagtttggaaatgtgattgacaatgccgtcaataacaagattcatctcctggccgcaaggattacggcagaacatctgccggggatagaagaactggttccgacatttcggtccctgatgatatattacgatcctctgtacacttcctttggagagttaagacagaggatagaggcattggggagcatttccggagaggcggtcagaaagaagaagcgtattcttaagattccctgctgttatggggcgcgattcgggctggatctaagaagcatggaagcgtataccgggctcgaccgggacgagattatagacatccacagttccgtggactacaagatctatatgatgggctttcttcctggtttcgtatatctaggcggtctggataaaaggattgagatgccaagacttgagacgcctcgcgtgaagatacttcccggggcggtagggatcggaggaggccagactggcatatatccgctggcgtctccgggtggctggaggctgatgggaggaacccctgtcgacttctatgatccggacagaaaagagccaatcctttgcaaggccggagaatacatacgttttgtaccaattaccatcggcgattattatgagatccgccatcaggtagtaaaaggagactatcaggtagaaattgtggaagaaggtgaagaaggatgtccataaaaatcacaatgcccggagcgctgactacggtgcaggatgccggaaggttcggctatcagaaatccggcataggaacctccggggtcatggatctggaatcataccagaaggcaaattacctggtaggaaatgagtccggggaagccgtcctggagtttaccttatttggcggagcgatggaattaacggaggatgggataatcgctattacgggtgcagatatggagccgacattaaacgacagacccatagccatgaatcagccggttccggtaagatcaggggatgtccttgcgttcggcatggcaaaagaagggtgccgctcctatctggccgttgccggaggcctggatgtcccggtggtccttggaagccgcgctaccaatatgaaatgcaggatgggaggatacgaaggccgtccgcttaaggcaggagatgaaatcgctgtcggggcagacagaaaagactttgaccagataaaagacaggcgtgtcaaagcccgtcagtatctgtcggaaatcacggtaagagtggtagaaggccctcaggcggagtactttaccgaggtaggcaagaagaccttctataaagaaacctacaccatatctgaccagagcgaccgcatgggctatcgcatggaaggaaagaagatcgaaagcgtttccggcaccgacatcatatcggacgggatcgcattgggctccgtccaggtaccggccgatggaaggccgatcgtgcttcttgccgacaggcagaccacaggaggatatgcgaagattgccaccgtgtgctcctttgatattcccaaactggtgcagggtagacccggggacagagtcagatttgtccggatatccgtagaagaagcgcagaagatcaacagaaagcggggaatctagatgaagaattattatgatatgaagccgacagaggtaaggaaattgatccgtgaagggaagatcgtgggcccgacttccggaatgtgtgccggatatgcccaggccaatttggtaatcctgccaaaagaactggcttatgatttccttctctttacgcagaggaaccccaagtcctgcccaatcctggaagtcagcgacgtggggagcaggaaactgcattacatcgctgatgacgcggatatcgcaacagatattccgaagtaccgcatctacagacagggagaactggaaggagagtacggaaatgtggaagacttctggcaggatgactttgtcagcttcctgatcggatgcagcttttcatttgaatcggcccttctggatgcggggcttccggtgagacatattgaggaacactgcaatgtgccaatgtacaagacgaacatcccctgtacgccggccggggtatttgaaggaaacatggtggtcagcatgaggccgcttccctatgatcaggtggctgaggcagtgatggtgacaggagagatgccacgggtccatggcgcgccgatccatatcggagatcctgaagtgattgggattatagatattgaccagccggattttggggaccgcgtcacaatccgggatggcgaagtgccagtattctggccctgtggcgtgacgcctcagaacgtcatcatgaatgtcaggccggatcttgttatcacacattccccgggtcatatgctgatcaccgatgtgaaaaacgtggaattaaaatattaacgatatatcagagagaaggaataaagaatgtatgcggtagatttgaactgcgatcttggagaaagttacggaaattatatctgtggaatggatgaagaagtgattccctacatttcctccgcaaatatagcctgcggattccatgcatccgatccaatggtaatggctaagacggttgcgctggcaaaaaagcagaatgtatgtgtcggcgcgcatcctggctatccagacctgatggggtttggaaggcgtaacatggcagtctccccggaagaagtaaaggcaatggtacagtaccagatgggagcgctgatggcactttgtaaagcgcaaggcatgcgacttgcgcatgtgaagcctcatggagccatgtacaacatggcagcaaaagatgagaaactggccctggcgatctgccagggaatcaaggaagtcgatccggaactgatcctgctcggcctgtcgggaagcgagatgcttaaggcggctgaaaagatcgggcttaaggcagccagggaagtatttgccgaccgggcttatgaagaagatgggtctctggtggccagaagcaaggaaggcgccatgattacagatgaagaagaagcgatcagaagggtcataatgatggtgaaggaaggaaaggttacagcaatcaccggaaaagagattgcggtaaccccccactctgtctgtatacatggagatgggccgaaggcacttgcatttgttcagaagatacgcaagacgctggaagcagaggggattacgatagcaccgcttaaagaagtcattggctagactgcctgagatgtcaggccggggatatgagatgtaaaggagtgacatagtttggaagcacaagcacaggttaagagggaaactgtagaagatattatattgcgccattcaaaacgcggcatgcatgtactgcgaaaatatatggatacccattattgccagaaagccgtggagaaactcttatctctgccatatggaaatatattgctcaccacagggttctatgtggaagggcatgcagagacggacgggccgcttgggacgatgacgctaggaaaggcattggccaaacttggctaccatcccataatcgttacggataaatactgtaagggattcttcgaagtagaaggcctggaggtaaaatatgtgcatcttggcgatggaaaagaggaatatgagaaactgctggaggaatgccagccggtagcactgatctccatagaaagatgcgggcgcaatgtccagaatgattatgcaaatatgcgggggatcagcataaaggacaagaccgcaagaaccgacatcctgtttgaaatggccaggcaagaagggattcctaccttcggggtaggcgatggcggcaatgagatcggaatgggaaatctaaaagaagtcattatgagcaaactggccttgaccccttgcgatatagaagtggatgcccttattatcgccacagtatccaactggggagcatatgcgctggcggcgtatatgcagaagattaagaagataaaagtacttcctacatataaggagattgaaaattatctgaagactattgtcaggatgggaagtgtagacggagtcacaaaagagcaggccatgagcgtggatggattctcgctggaggtagagcgtgagattctggaagaattgcatagggccgtgagatcctattaagcagaatcatccccgggcggcagagttgcgtgaatattcttctccgtacgcagtacatagtgggtgcgggtctggcatactccggcctggcccttgacccactgatggatatgttcaagatgctcgggagaacggcaggccaccttcagaatgtagtcggagtctccagtaaggtaatagcaggaaatgatgttcggatgctctcctacattctcaacaaaggagtcattgtagcgggggtgctccaaagtcacttcgatcaaagcagtgacggcattgccaatccgggaatcattggttatgacggtgtaagattcaatgatgcccagagcctccattttccgaattcgctcaatgacggtggaaaccgacagatgaacagccttgctgatatccgaggccttcatccttgcattttcttttaagtttttaagaatctcataatccagatgatccaccttgcatcctccttaaaaagtagataaaaaaccttgtgtttattttaacatatgacagtaagaaaggcaaaagtgtcacgggagtttttttcgtacatgctatacttaagaaaagtatccggatgatgattacatgaataggaaagatatctggaatactaaaaataagtcatatggagggactacacatgaggttaaaagacaaagtgattctggtcacagcatccaccagaggcattggcctggctatcgctcaggcatgcgcgaaagaaggagccaaagtctacatgggcgccaggaatctggaacgtgccaaggcgcgggctgacgagatgaatgcggcaggcggcaatgtaaagtatgtttacaatgatgcgacaaaagaagagacatacgtgacgatgattgaggaagtcatcgaacaagaagggcacattgacgtgcttgtaaataatttcggctcatcaaatcccaagaaagatcttggaattgccaatacagacccggaggtattcatcaagacggtaaatatcaatctgaagagcgtatttatcgcaagccagacggctgtcaagtatatggcggaacatggaggcggaagcatcatcaacatctcatccgtaggaggactgataccagatatctctcagattgcctatggaaccagcaaagcggcaattaattatctgacgaagctgatcgccgtacacgaggcaaggcataacatcagatgcaatgcggtacttccaggaatgacggcaacagacgcggtgcaggataatctgacggatgacttccgaaacttcttcctgaagcatacgccaatccagcgtatgggactcccggaagagatcgcggcagcagttgtatacttcgcaagcgacgatgccgcatacaccacaggccagatccttactatatctggaggtttcggattggctacgccgatattcggagatctgtctgaacgctcagacgcccgcgggtaggctttcatgggttaatgtaatcaaaagaagaatcaggaaaagagacagccgggagtggctgtctcttttatctatattaattattcgaagataaatcttatcctttcaaaacttgacagataaattgaatgagtgtaagatataagatacaaacgtccatcataacaaacagacatggtatttaacaatttcaatatgaggtgatggcaaaccgctgtatacataacgcaggagaaaaaatttaaaatggaggtatcacaatgaataaaatgtcaagggatgaagcttgggaattacttacggaatatacaaagacgccggcgctgcgtaaacacgctttagcagtcgaggcagtcttgaaacattttgccagattgaacgatgaagatagcgaagtctggggcgttgccggcttgctgcatgatctagactatgaaaaattcccagatcagcattgccaaaaggcagaagaaatcatgcgcgaatctggagtcgatgaaacgtacatccgtgcaatgaaatgccatgggtatggcatctgtacagatgtgaagccagaaagcaatctggaaaaaacactgttcacggtcgatgagttgaccggacttataaatgcgctttgcttaatgcgtccttcaaaaagcgtgctggatttggaagtgaaatctgtaaagaagaaatttaaagataaatctttcgccgccggcgtaaatagagatgtgattcgcagcggctgtgaaatgttgggaatggatctggataccgtcattcgtgaaacgatagagggcatgaaagaaaatgcggaagaaatcggattaaaagggaatctataatttggcataagtaatcaataacaacgaaaacccgctagccataaggcttgcgggttttcgctgttgttatagttaactaaaggaatgagagtaaagtgcgcaccgggcctttcccggtgttttactttatgaggggggagatagttgagtgttgatcaactatctgatatttattataaaggctaattgtgtccaaagtgttttcattctcttaaagaaaacgaaaagttcttaaaaagctcttaagaaggagaagaaaatgatacaaaaacctctgcttgacattcttagattaaaatgtaacaatagttgcgtaactgatgtaacataataaaacttatatagaggttagccagtatgcccccaaaagcaaagataacgaaagagatgattttaaatacggtcctggaaattacaagaaagacaggattcgaaacggtaaacgcaagaagtattgcaagtagattacaatgttctacccggcctatttttacctgttatgagaatatggatgaattaaaaaacgaatttcttgcttttgcttatgaatattatgagcagtatgtcactgactatcgcaattctacgaaggtcagccccttattgctccttcctctttcttacattgaatttgcccgggaagaaactcatttatttaagttattatttattaatgatatggatttgaagatgaaagaggccaaggacttttatgaagaagcggataatgaggaaagggcaaggcttttttcagaaactgttggaatagggctggaacgcgcaagagtaatatttttggatttattcctttatactcacggcatagcagtcctaacggcgacgaaaaagataacattagataggagtagcgctgaaacaatggtggcaaatgtattgtcggcttttataaagcgtgagaaaccagattggaatgatgaatatctaaggagtacaaaatgagaactaatcaacatttgatcgacttttacaatcattatgatgaggatagccgcctggcaatgaaacatggctctgtagagttcctcaccacgatgcattacattgaaaaatatataaagcccggcgaccatgtgctagaagtcggagcgggtactggacgctactcccacgcgctggcacgtcagggatacgaggttgacgcaatagaactggtggagcacaatatagatatatttcgtcaaaatacaaaaccagacgaaacgataacgatcacccaaggaaatgctatagatttagccggctatccagacgataaatatgagattacgctgctgttgggcccgctgtaccatctttaccgtatagaggataaaagacaagcgctgcgggaagcaattcgcgtaactaaaccaggcggcgtggtttttgctgcgtatgtgatctccgatggatgtcttcttgacgagggattccatcgtggcaacatcaatgttgcagaatatattaggaaaggattgcttgacgctgaaacatttgccgccaagtctgagccaaaggacttgtttgaacttgtccgtaaggagaatgtcgacgagttaatgtccatattcccggtgacccggctgcattatgtggccacagatggctgcgccttactgatgcgggaagcgttggacgcaatggatgatgatacttttgaatggtacctgagataccattttacgacctgcgagcgggaagatctaattggcgttacgagtcatgcggttgatgtattcagaaagaatgtgagaaatataaatggtttataatatgtagaaacagcgaaaacccgctaacctttcggctaacgggcttcgttgttgttatagttatctaaaggaatgagagtaaagtgcgcaccgggccttccccggtgttttactttatgaggggggagatagttgagtgttgatcaactatctgatacttattataaaggctaattgtgtccaaagtgttttcattctctaaaagaaaaagaaaagttcttaaaaacatcttaagaaggagttaagcaatgcttaggagggcatttaagaacggacgagaggccatcagtccagcatgtccgaatacaaatgaagtgactttgaaaaagcggagtgttacaatggaagagatcatgatggtctatgatttataactgataaattgagagaaaggacaagagataatggaatataaagtgaatgaccaggaactgaatgcttcaacgtttattacgtttgtgaatagggtatggccaggggactatgatctggataagacgcaggctgcgctgtcgagaacattgaatatcacagcttacgatgaaaaggaacttgtgggctgtctgcggattctttcagacggctattattttggaaccattacagaactgcttgttcttccaaagtatcagaagcaaggaattgggagcaggctgctaacgcttgccaaagataacactccgaccatgctgtatttcggcgcacagccaggagcagaaggattttatgaaaaaaacggatgtcagaagagtctgcaatcctatttaatagataaagaggactaaaatttgaaaggcattttaggttatgaaagaacataagtatgaggtattgctggcatccgttattgctgcccgcgctacatcatttatatttagcaaaatgattttggagtacatagacacgtttaatctgctggcgatacgctgcttgctggcatttgcaattctggcagtgctgttttttaaaagattaagagacatgccgtttaaaaccgtgatttccggtgttattgtggggattttattcttccttgtcatgagtgcagagctaactgcgctgaaagaggcttcgtcctccacggtttcgcttttggaaaattgcgcgatcatcttcgtaccattgctagaggcaattctactttggaggcttccaagcggaagaatcatgatcagcgcattggcggcgtttcttggcgtggcctgcctcactttggcgcagggcggacttactggcggcgtcttttggggactgctgtcagcggtactctatgccattgctattattgtgacggcaaaagtatcccaaggctctggcgatcctctgtgtataggaatcatacaggttggtaccatgggcgttcttgccctttccgcatcctttctatttgaaactcccgcactgccagctggaagcaggcagtggatcatgataggaattcttgcagttgtgtgtacctgctttggttttacattacagccgatggctcaaagcagaatctcagcggagcgcgccggtatattttgcgcaataagtccggcgatagcaactttgcttggcgtggccgtattacatgaaaatattgggttcctggggattgctggattgattttgatactgtccagcatagtcattgcataaagcatgtaaaaatgtcgtaaagtatgcaatgacatttttatctatagtcgaagaatatggttttaaaaggggctttcccatggcagatatcccgcttggaatagtatagatcgatctttagggtagtaggagtgccattaatagaattgtgcttatcttcgatatcccggatgatttcatctgatttccaatatttatagacaagaacttttaattcggtatctctggttccaggagtattaaatgacatgctgctaagtacatggtaatcagggagattaatgtagtaattaacaccatttaacagttggattactagaaataagataattaacttctttttcatgttcatatatctcgctttcaaattatttagaggggataactgtatagtacctcactgtatagtgaattactatataaaaatttatcgaatatactttgtgcagggagtgaggtatatgggacatggtcatttagagttaaagattgaagaattgcttaaagaaaaaggcgtcagtaaaaataccatttgtaaggaactggatattccaagatcgaattttaatagatattgcaggaatgaattccagaggatggatgcaaatctaatctgtaagttatgtgaatatttcgaatgtgaagtcggagaattaatagtgtatgtgaaagaatagaagtctgccagagagagatttgtgcaggcttttctttttttgtcatagacatctgattttttatggctgcgccatgttctgtatggatttatggattttatattgtaacggccggacttgatatttgctatagtcaaaaaggaaaaaaggagaatccggatacagagcgaaaacccgctaaccttgcggctaacgggtttcgttgttgttatagttatctaaaggaatgagagtaaagtgcgcaccgggctatatccggtgttttactttatgaggggggagatagtgagtgttaatcaactatctgaatctaagtataaaagaaaaatatgtccaaagtatgttgaatctctaaaagaaaaagaaaaattcttaagaaggacttaagaacttgggaagaaaacctaaaccagcacggctacggcttccttctgccttaaatgagcagtaaggatatctaaaaattcgctggatgtaggctgcgagtccagaggacgaagggcaatttcctggagcagccggcggttgcctctttcccaacagactctgatgacggttctgatatctcgttccacgctgctgcttgtagtatggtaattttttgcaatctggggatatagtaatttgctcacggacagaagatagtcttcgtctctcaaacatagtttcaccccatagttcagataccggtatccacggtaggttgcgccgatgccaagagcacgtataagacattcgatttctagttcgctcatgtgattttcctcatctaatgccttacattgaaaaacaaatatgctatgtgcttctattatataggatatttcttcgatatgttgcgactcggacacaataagtaagagttcgactcatttcgacatatccaagttaacaaaaacagaagaatcaacatatagtatataaaaaagaaggtgggacattatgagcatccatggaatagatgtaagcagatttcagggcagcatagactgggaggccgtaagagcgggcggaatacagtttgccatgatccgggccggttatggagaagggaccgtggaccaggagttcaggagaaatgccagccagtgcaatcaggctgggctgccgttcggagtatactggttttcctatgcgtatacgccggaaatggccaggcaggaggcagaatcctgcattaatgccatatccggatacgaggtacagtatccggtctgctttgactttgaatatgcatcggtggactatgcggaaaatcaaggcgttaatgtgacaaaggaactggccacttctctggtagatgcattctgtcagagagttgaagagttgggatattttgccatgtattacagcaacctggattttcttaaccggatgttcgacgcttccttaagaagcaagtatgcgctctggtacgcgcagtatgctgcagagccagctgtcagcggaatggctatttggcagtatagtgacactgggcgagtaaatggcatatccgggaacgttgaccaggatattgcctattatgatctggcaaatgtaatatccagggctggactgaatcggctaagaggcgaggtatctacgccggattccgcgacgccggaacccaatgacgtgattacctatatcgttaagccaggggataccttaagcgggatagcgcttaggtttggaacgacatatcaggagattgccgtgtacaacaacatttctaatcccaatctaatctatgcgggacagcgtctgctgatcccactgggatataatccgcaaaaagtgcgctattacaccattcagccaggggataccttaagcggaattgcccttaagtttggaacgaccgtagcagagctgcagcgcctgaacggcattcgcaatcccaacctgatctatgcgggaactacgatcagagtatgagaggaagcagagaaaattggcctggaatccagatactggaagccgggcctttttttcataatatcttaagaaaattcccagattgctcttaaaaaatccctgctattcttgtatagtataagggaggtgatgaaaatgtctaaaatattagtatgtgatgatgataaggaaatcgtagaggccatcgatatatatctgtcccaggaagggtatgaagtattaaaggcatatgatggggaagaagcactgaaggtattgggcaaggagaagatagaccttctggtaatcgacgtcatgatgccaaaactggacgggatcagagccacccttaagatccgggaagccaacaatatgccaatcattattctttcggcaaaatccgaagacgcagataagatccttggccttaatgttggtgcggatgattatgtgacgaagcctttcaatccattggaactggttgcaagggtcaagtcgcagcttcggcgttatacgcagcttggcagtactgcgaatcataaaaatgaagcggtctatgaagttgggggcctgtcgatcaatgatgacttaaaggaagtaacggtggatggagagccagtgaaacttacgccgatcgaatataatattctgctactgctggtaaagaatcaagggaaagtcttctccatagaccagatctatgaaagtatatggaatgaggacgccattggcgtggacaacacggtggcggtacatatccggcatatacgtgaaaagatagaaatcaatccgaaggaacctcgttacctgaaggtagtatggggagtcggatataaggtggagaagctttagaagggagtttatatgaagcaacaatggtacaaatcaaatgttgcaaaagggatattgatcgttgcccagcacatattactggtcataatcgtaaccagttttatgtggatgctgtcctatccagctcttagaggagaactatttgtgggaaagccggccaagaaatacgaggacaccgtaagttttggcaaccaattattgacgatcagccatgacgtggcaaacggcatcaagctgcgcaaggtgtttgagacggatggcagctatgatccgcaaaagatcgtagacatccaggaatattatacaaatagggagatcaataataaaaatagcagcgggctggcgtataatctgcaggacttatacagctggggagaggaattgtatgacaaaggagagatcagctatcaagacgatagcgtgatagcatttaccgcccaggagatgccggccgatgataatatcattgtctgcaagcggtctaatgatacgtatcattattactattacagcgaatttaggaaactgatagacagcggacagctgcgattcgttatcagcaatgaaattgaagggatgtccggggaagaaattctggatgaactgcataatggaagccgctatgaaggggaaaatcagggacagcagtttaagggcctgcaagacgcagaaggaaagattgaatttatagactgctggagttatgatggaaactggatggaggaaagatattcgccaatcggcgagaagagcatcatagatctcgtaaataataatccacagtggaatggaaggctgaatgaagcctttgaaatgctgtatcagactgtaaattcgatattcagcgatatgacagcctataaagatctggatgaatcctatcaggaaggcgatacaaatctggcttacatgtatgtggatgaggatacagggcagatatttaccaaccgcaaggagtatgaggactactccaaggtggaagaaaaccttaagaagattcgcggaatggggaaatatacgattgtaagacccaagctggcggactttgaatcgaatcttaaggacaccgatgcgacgcagtggaggaatatgatcaagtatcctgtggaaggaaagaattttatttatgcagttggagtagacactgcttacccaatccaggatgatttccatgccgataatcttatgtatgaaaaatatggatcgaatgctagaagcatagcaatcctgggagtccttgccgctatattgtttgttgtcttcatggtgtggcttacaagcatcgcggggaggcgtatgcgggatgaggaactgcatctgaactggtttgatcatattaagacggaactggcagcagtgatcatagtgctgctttgggggattcccctgatgctcgcttatattggaattcctgttacgtcgcttcattcatacagtgatggcgagacgatcatctatcaggttgattatgtatacaacgctctgccatatgtcctggccggaggagtcgtggcagcatatacctgcggcatgttcctgatcggatatcttagcatggttcgccggattaaggcaaaggaactctggtccaacagcgtgctgagatggctttgcaaatttatagtacagttattcaggaatctccatacaacatggaaggttatattgctgtttggcctgtttgtgggaatccattggcttgcctatatcagcatgggaagtggcgtctggcttttcctggccctggcggcggaggctgtggcattcgtgttcctgatccggcaggcaattggcaggcagaggatcaagaagggaattgagaagatatccggtggagaggtagattacaagattccgatatatggcctggggaatgaacagagcgatatcgcgcagcgtgtcaactctattggagaaggattggacgcggcgctggaggaaagcatgaagagcgagcgcctcaagacagacttgatcacgaatgtatcccatgatatcaagacgccgcttacttctatcattaattatgtggaactcctgaagcaggaaaattttgaaaatccgaagattcagagatatctggaagtgctggaggctaagtcccagaggcttaagaccttgacagaggatgtagtagaggcatccaaggtaagttccggcaatatcacgttggaatatatgaatattaatctcgtggagatgatccagcagaccagcggagagtttgaggagaagtttaaagcccgcaaccttaaggaagtcttgacgctgccggagcaagaagcaatcatcagagtggatggacgccgaatgtggcgtgtgcttgagaatatctacaacaacgcggccaaatatgcgatggaaggaacccgcatttacgcggatctggaagtcagagacttatcagcggtatttaatctgaagaatgtatcggaacagcagctgaacattacggcagatgaactgactgagcggttcatacgcggcgatatctccagaagtacggaaggaagtggtctgggcctgtccattgccaagacactcacacagatgcagggaggaaaattcgacctgtatgtggatggagacctgttcagagtaacgatcacattccccattgtattggcaaaggcggataacgatccggcagaagatggacgtataaatgacggacagacagaagcataatgctgcaaatgcgtaaatatggacgcggcacttttcaaaagtgctgcgtcctacttgcgcttattggaaaaaaacattacaataataatattatggatgaattaagaaaattattacaggaaaatctaaatatagagtttatctcagcagttctgagcaatccacggcaaaaggaggaggcatccaagatcaaggtgcgtcctttgcttaagaaggagcagcgggtgttccagctggagatattccggaacaatcaggcatttcataagaacgctgatcccggggaagcctgccagcttctgcttggctacatggaaaatatgcgccagatgcagatggagacgaagaaatatgcttatacggtgctggtaagcaagaaaggcaaggtaacggtgaagaggaaggctgcaaaaggtacgccggccagtgtggatctaagccataaccggaagaagcagtacattctggaagagggcgtgccagtaccatttcttcaggatttgggagtgatgacgccggaaggcaggatcgtccatgcaagattcgacaagttccgacagatcaatcgtttccttgagtttatcgaggatatccttcctgcccttgatagggggcgtgaacttacgatcctggattttggctgcgggaagtcctacctgacatttgccatgtattattatctgcatgagaggaagggctatgatatacggattatcggcctggacttaaaaaaggatgtcatccgtcactgcaatgagctgggcaggaaatacggctatgacaagctgacctttttagaaggtgatattgcagattatgaaggcgtcaggaaggtggatatggtggttactctgcacgcctgcgacacggctacggacttcgccctggcgaaagccattggctgggatgcgaaggtgatcctttccgttccctgctgtcagcatgaactgaaccggcagattgacaatgagacattgaagcctatccttggatatgggctgatcaaggagcgcatggcggcgctggtgacggatgcgcttcgggcccagtatctggagcacgaaggatatgatacccagatattggaattcatcgatatggagcatacgcctaagaatatcctgatacgtgcggtcaagaccgggaaaaagggggagaaccaggattcgatccgccgctgcgaggagtatcttcatgtagagccgatgcttggaaggctgctggatcataaaggggaattatagatgagattaaagaatcgattgatagatgcgggaattctgatagctgtattcattgtagcagtcatagcctttagttatttcaccaacaaaggaaataacaatatgactgcggatatgggtgcggccacctatccccaagtatcattttcgtataatggatttaacttaaatacgctgaccggatatgcgaagaagatggacataccagcaatgagggatacggcaactccggttgcggaccagaaggtggatgtcgcgatccaggcgtatgaaaataaggtatccagcgtgaactatatcgtctatacgctggatggaaaagaagaactgaaaaaagagaaggttaagaagccgggagaggagttctcgatagacttaagtgccgaagggcttatgaaggaagagcgggttcttgaaatcgtactccatatgccggatgagaagtcggtatacttctatacaaggctcgtggatgccaccaatgcgaatatgctggaatgcctgagctacattagcgattttcatgagaatgcgctgggcaaggtagagggcgccggggtcggcgcggcgatcgagccgaatgagcagggagataatacgacgctgcagcatgtgacgatccactcggattatgaccatgtttcctggggcgagcttgagccttccgtagagcaaggcgagcggtggagcgttaaggagatcaacagcaactatgtttccgtacagctggaatacagggtccggtgtaaaggagaggaaaatgataccgatgtctataatgtgaaggagtttttccgcgtccgacatataccggatgtgccgaagacgtaccttctggattatgacagaacaatggatcagatatttgacccgatgaagcatgtcctgaatgagaagggcgtactgcttggaatcgtacctcatgacatcccttacatggttaataaggatggctctgccgtatcctttgtagtggcaaatgaactatggaattacaataagggaacagaccagatatccctggtgtttagtttttctgatgcggagaatacggatgtacgcaatcttaccgcccagcatgaggtcaagctgctggaagtagacgatacgggaaatacgacgtttgccgtctacggatatatgaaccggggcgagcatgaaggcgaggtaggggttgccatctactactatgatatggaaaaaaattctgtggaagaaaaggtttttatttccagcaaccagtctttcggaagcgtgtcaaacgagcttgggaagctggcttattacagcgtggatcgagatatgctgtacgtcatggtagagggcactttgtatgaatataatgtaaagaaggaagaagagggaaccctggtaaaagggctgaaggacagccagtacgtggtgtcggatgacgggcatctggtggcttatcagtctgacggggccttgaatgaagccagaaagattattgtcaagaacctgtcaaccggaaaagagcgtacggtggaatgcgccgaggatgagtgcataaggccgcttggattcgtaaagaatgactttgcatatggcgttgccaagactgccgatactggaaaaacggtttccggcgagatggcggtgccaatgtataaagtagagatccagaacagtaagagcaaggttgtaaagacttaccagatagacggcacttacgtgctggatgcagtttttgaggataatatgatcacgcttggccgggctacgaaggaaggcgggacatataccaatatagcgcctgactatattaccaacaatgaagagaaggaaaagagcaatatatatctggaaacctatactacggagttaaaggaatctcaggtgaggctggcgtataataatggagtgacggataaggagccgaaggtgctgaagccaaagcaggtgctgtttgagaatccgacggtgataacatttgacgatgtagatatcggcaataagtattatgtctatggctatggaagactgagaggcatctatgaccgtgcaggagaggctatcaggaatgccaatggctgcaacggcgtggtggtggcatcggaccagtcctatgtatgggagcgaggcaaccgcaatctccagcatatcatcagcgacaaagacgatattcttcagtccatccgggaccggctgggccagaaagaagcgccggtagatattattaaggatataaacgacggcaggagcctggatctcaccgggtgcacgacagaggaacttttgtatgtcatcagccaaggcaggccggtcatagcaatgctggatacagaaaatgcagtgatactgatcggatataatgaggcagatgtaatctatatagacgttgccagcggcgagcgttcaagcgttccatatgagcagatggatcagatgacgcagggaagcggcaacacatatgttggctagctacacaggctggaagaaagaatggcgcaaaaaagcaggaaaacttttcattgttttcctgctttttgtcgtaaaacctgtattacaccgcagtaggccgaaagacgatattcttatacttgcgcaatgcgaagtacagtaccagtcccagcaccccgcaggataagacctctccgatcccaacggtcagcatcataaaagggataggcagcgacacgctgtagccgtaacgcaatacgaatggaacgacaatcgtattggcggcaattggcggaagcggagccaggaacgggctcttgccacgcagctgataggtaaagattgctccgatcagggttgcaagacttccgaataggatatccggaagaattgcgcctcccaagatgttgcccaccaggcaccctacaaacagcccgggtatcgcagccggggtgaatagaggcaggatagtaagggcctcggaaatccggacttgaacctctccaaaagaaaacggcgcgaatacataagtaagcaccacatagatggcagcgatcatagctgcctgggtcagaaaagtaacgttcttgttcttcataatattgtctcctttagttttgttttacgtgtggaaggtctcgaacacacgattcattttacggcggaaatcgccggcaagcccttaagaccttggttttatgggctttgtcacggttgatagtatagcatgcgggaaaagaaaaatcaatggatcaacctaaattctctgaatgagaacaaattatggaagaatggtgctgtactggcagcccttccacttactcgccgcgtatcattttgatatatttactaggtgtcattcctgtggattttttaaatatctggctgaagtattgtggattattttcacatccaaccatatccgcaacgcattggatggagtcaatatttccagacgccaatatttcctttgctttctttatccgtgtatctgtcaagtattttgaaaacttacatcccgtttctttcaggaattttttgctcaggtaatctacattcatatacaggtaattctctgctatccattttaaagacaattctgcgtcctctatatgcttttctacatactccatgatcttctggctgatatcccccgtatgctttgacgaatggtattcttcataggaagcagccaggtgttccttaagaagcgcgaagatggtgctgcagtcattttcctgctccagctttaccaggaattccgcggctgtcaccatgtcatacgtatggttattagagactgaaaatatgataacagaagcagccagctgctttaagaaatcagcatccgatatggactgcaaggtgcaaagcagcgactgaaaagccgggcttgatgaatcattctgttccgaaaatgcagaagaagtaagcttttgcacttctttgataatgttctggtaattatatattgaaaaagtagtggtgtcttctgcaaaataaatgatctcgtattttcttaaatgctgtattaatacttttagcagttcttggagattggagtatgattcatgcctgtattcaatagaaaccggctggcttaagctaagtgtatctaaaaaatgataaatactgctcaaatcaagctgcatggctggaaaaaagaaaaccaatgtattgtagacgtaaatcacgctgaatctaataccgggaaagtgcttattgcgaaactggcgcagctgtattagcacttctttataattgtccggaattacataataaacataaaacatctcataacgagtatcttcgaaatcaagatactgcttataattacaggcaatctgggagataccggtgtctgcttcctgtgcttcaagactcaggctgtcattaataattccgaccatcaagttctgattgatattgcggcttataagagtctggggagtctcgcctctggtggcgagataatttgtataatcctttattacatcctgcaggctctcaataatctgttcttcattgcaaggcttaagcagataatgcttcactccatactgcatggctttttttgcatattcaaattccccataacccgacaatattataaaatgagtgtctttattgatcccgtggatcttctgaatcagttccagcccggagagtcccggcatcttgatatcagtaagaacgatgtccgggtattcatcgaggatcatattataggcttcaattccatccctggctgtaccaatcagctggattccaagagaattccagtcaatcagtccggccatagtttcacggataatcttttcgtcatcaacaatcagtagttttaacatgttctcctcctggtataataattctggctactgcatgctcgtcgtctttattaaatagatgaagtccgtactctgaaccgtacgtgagctggatgcgcttgtggatattgagcaggccgatcccgaatccatggggggttaccagaccctgatcaagctttcttaacaaatcttgttcaaactgggaatcattattgaccacatctatatatacgttatccccggaatgggtgccttcaatctggatctggcacacttccgtgctttcttccatcgcatagttgattgcattttccacaaggggctgtatggtcaggtggggcagactgatatccatgatagagtcatctatttggattgtatattcaaggcggtcttcaaaacggatctgctgtatggtcaggtagcttttaacaatttcgagttcacggcggactgtaaaggtcttatcttttgtatttaaggtttcccgcataagtgtgcccagcgactctaccatggatgatatatctttttcaccgatagcttttgcgcgccagttgacagcctccagtgtattgtaaagaaaatgagggttgatctggttttctaatgcctttaaacgggcatctttcgaaagaatttcatttacatagttttcctgaatcagattccgtatctttaaggccatatggtcaaactggttgtgcagtaccccgacctcatctgtacgcccgctataatcgtatccagtatccggaggcgtggattcatctcttccgaaggccttcattttttggataagccggctgaaatcgctggttacagaacggatgagcatcctggacagcaagagggaaatgagaacagaaacaaggattaccaccagtgccatgagttttgtaaagtttaatgtagatgatatatgtccgtatgggacaaggcagatataattccaggacgtgttcccaatggagccttttactgcaaaatacttaccagcatttacagaaatcacgccataatcggtcttcagtttcgttccaattgtgttgatctcgttagaatccaggctttctgagtggtaaaactctgtatcttcgtcaaataatatatactgtgtttcatctgaatgcaggacagaattggtagaagaacgtaccagacgatccatgtctacgcctacgacaaccgtgcctaatgtctggaaattcatctggtcgactctgcggcattcccgcccaagaaagagcccgtaggaattgcagtaatctgtaacccagtatggatatccggagttgttattagcagctttaaccacattttggtggaccgtatccggcacttgagaacttctggcctcatagctttgagttgcaccctgtgcatgatataggttaatgtaactaatattgttatctttatacgtctgataataatctgcaatcaatgtgtttagcgaattctcagcattttttatacggatatcaggatcttcttctgccagagtgatcaggttttttcttatattagagttggagacgaccgcgcttgtcatagattcgatgtttgacagcttttttgatatatcctgggaactatatgtgagtgaacccgcaagagcctggtacagcagtttattactggaatttaagaccagcagtataccgctgaccgaagcggatatcattaagaacacaacaattaaaatgatacatacgatctttgtgctcaactgggaatttgtgattttactgataaaagactttttacttcttagcataaatatacctgtttccttatgtgaataatgttagtattgaggtttttcttattataatgcatatttcaatagggaaaaagggatttagaaaataggacggaattttgaaaaaggatgtcggaaaagtttatattaattttataatactgtctttataatgtgcttatacaaaagaaactcataaatcacacaaggttaaggaggaaagaaaatgaaaaagatagtttctgtattgttatgcgtaatgatgattgcagtactggcggcaggatgcggcagcagtgatgcaggatcaggaggcaagtctggcagttcgaagacaaaagacgctggggatgataagacagcaaatccagaagagtatcaggtagttatgattgtaaagcagagtgattcctggttcgatgatatgactactggagtagagcagctcaagaaggataccggcttaaatgtatcggtacaagtaccggagacaggggatgcggcaagccagatctctattatggaagatctgatagcacagggcgtggacgctatctgtattgtaccaaatgatccggacgcgcttgttcctacgatcgaaaaagcaaaagagtctggtattgttgttgtaacgcatgaggcgcctggtattgcagaaaatgttgacctggatgtagaagcttttgtcaatgaagaatttggtaagttattcggagagaagcttgcaaagtctatggacggaaaaggccagtatgctggttttgtcggcggccttacgatggagactcatatggcctggtataaagcagcaatcgaatatatcaaagaaaactatccagatatggaatgtgtgacagaagaaccttatgaggatggtaacagcgttgacggcgcacatgataagacattagaaatcctgaaagcatatccagatatcaaagggctctttgactgttctgcacatggcggcggaatctgtgaggcactgcaggaaaagaataagacagatgacgtatcagtcgtatcactggcactgccttctatgtcggccacatacctggaagatggatctatgaaagcaggacttgcatggagaccggcggacgcaggctatgcaacatgctatgctgcatatctgctggcatctgggcagaaggtagaaacaggtactgaccttaagattactggttacgaagatatccaggtaaaagacggtgtggcatatggtaatgcacctctggaattttcagctgataatataaacgattataaattctgataagaaaagggtgccgcaaaataacaagagaatagttattgggcggcacctgaatttattcatggaggtgagatcatgggaacagttttggaggcaaaacacataaataaatcttttattggcgttcaggcgttaaaagatatcagcatcaaaatcaacagtggggaaattcactgccttgcaggggaaaacgggtgcggaaagtcaaccctggtcaagaatatatccggcgtctatacaccggattcaggggaaatcatacttggcggaaatacatatcataatctgacccccatgcaggctatgaaggaaggtatacaggtaatataccaggacttgtcactgttccagcacctgactgtggcagagaacattgcaatcagcagacttaagtttgatagaaataagatgataagctggaaaaaggtatatgccatagcacaggagcagttagacaaaataggagtaaagatggatcttggccagactgtgggggagatttcaatggcgaaccgacagctgacggcaatctgccgggcgttagcgcaggatgcgaaaatcctgttcatggatgagccgaccacagcccttacaaagacagaagtagaacgtctgctgaatattatggtggacttaaagaaaaaggggcttgcaattatatttatcagccataagcttgatgaagttttctctgtggcagatacgataaccatattccgcaatggagagaaaattggtgattttaaaagcgaggatttagataaaaagagcctgtcatattatatgacgggacgggaagtggagtatccaagataccaccgcacgagtaaggaagatacaccgatacttgagattgagaacctgaccagaaaaaaccagtacgaaaatatatcactgtccatacgtccaggcgacattgtgggagtgaccgggctgcttggatcaggaaggacggagcttgcattgtctttattcggattaaatcctacgaccagcggccggattaaggtggatggcaaagaggtaaaacttagttcgccaatgaaagcaaagaaatgcgggattgcattgctgcctgaggacagatttaaccaggggctgtttatgaaacgagagattaaagaaaatatatcctcttccatattagatgagatttctaataaaggagtactgaataaacagtctgaggaacgcacagcagagacatacgtcaagcagttaaaggtaaggacgccttctattgatacggtaatagggacgctgtcagggggaaaccagcagaaagtggtcattggcaaatggacggccacatgtccaagggtttttattatggatacgccgacagtaggtattgatattgggtcaaaggctgagatctatgaacagatacataaatttgctgaggaaggaatggctattatctttatctcagacgaagtacaggagattctggcaaactgtaaccgggttatggtgatggctgaggggaaatgtgtaaaaatgctggaagaagacgacttaaaagaggaggcactcgtatgaggacgaaaaaaatagaccggtttcagggaatactgctgttgattattcttctctatagtatatttgtctcagtaaagaatccggcctttatacatatagagacaatatttgatattatccgtgtggcgtccactacgctgatggttgcgatgggactgcttgttgtcatgatctctggcggaattgacgtatcgttcatgtctatcgcgctgtttggaagttacacgacgattcatattatgatatcaatgggaattgacaatctgatctttgcatttggcatttctgctttgattggaggattacttggcattattaacgcgctgttaatcaactggctgaaactgccgccgttcattataaccttgggaacgcagaatcttttccatggcattatgactacttttattggagacaaatcatttggcgcaggcgtgctgccaaagagcattcattccttcggccaggcagccgtgataaagatcgggggcgtgggcttgacatcatctatcattcctgtattacttgctggcgccctaacctggttcattctttaccgtaccatgaccgggagaggaatcttcgcagtcggaaatgatgaggaagcagccagaagggctggctttaatccattcaaaatccgcttgattgtatatgtgtactctggaatcctggctggaattatggggatgatgtacgtagcgcagacaaatgcgctctatccaaataaactggtgggggatgagctgatggttgtggcagctgttgtaataggcggtacgaagataacaggcggacagggaaagattttaggtgcgtttcttggtgtcattattatctatctactgaacaccacgttgattatgatcggcctgtcatcctcctggaacaatctttttgtagggacaattcttgtaatctcagtggcagtgacttcctaccaggagagggttaagaaccgcaacaatctaatttttacggaatagggggatgaaagatgactaagataaaaaaatgggctggcagagatatgaatctcactatattgatgggagttacgcttgttatactgatctggagcgggatggcgtttgggcagtccatgtattctatgcggaatatacagtccatgacattccagatacccgagtttggctttctggcgctggcaatgatgctgtcaaatatgatcggcggaattgacctttccattattgctaatgcaaatactgtggctattctgacagcgtatgtgctgaatggccaatggtcctttgggacagagggagcggcaagagttgtgctggcacttattttcgccgttttgtgcagcttgttgtttggtctgtttaatggactgttaatatcaaaaacatctgcgccgtcattgattgcaacgttgggaacgatgactctgttccagggaattggaatggcagtgacagggggagccagcgttggaggaattgaagaaaaattcgcgcagattggaaagagcacgattttgaatcttccggttatcttctggctgtttatccttgcgtctgtaatacttggcctagtaatgtcgtacagtggttttggcagaaaactgtatttgtacggagataatccggttgcagccagattctcggcaatccataatgaaggtatctgcatcggcacatttctgttgacgggcctgcttgcagggattgcgggactgattattctaagccgtgtaaattctgccaaggtggggtatggagattcttatctgcttcagacgctgattgtctgcgtaataggcgggatcgacccgaacggaggaagaggcaaagtatggggcgtattgattgcagttataatgatgcagattctgtccagcgcatttacaataatgtccctgtctccatatacgaaaaaattgatatggggcattatgcttgttctcgttcttggattaaactttattattaaaaagtattctggcgtgagaatgctgaaagccagcttgagtgcgaataaagagaaataagcaggaggtcaaagaatgaattgcagaaaatatgaagaattatatcgtaccgtacttaacgaacacagagaagtctttgaaaagcaggatctggatgaggttactttatttatggaacaaatcaggaaggcagatcggatctttgttatgggcgtaggcagagaagggatcgcaggccggtcatttgccatgcggctgatgcaccttggaaaagaagtacactggatctgggacgacacgacacctggcatgcatgagggggatttatttattgctataaacgggtcgggtaaaatcggccacattcattatgtggtcaaacaggcaaaagagaccggggcagcaatcactgtggtgacaggagggccaaaagaaaagacggcccgcctggcagactgtgtgttatttgttccggcaagtgtatttaacgggacagactctagagcggtaccgtccgtacagccgatgggaaatctgtttgagcaacacctgtttttgctgtttgatattattattatgctgctggaagaagagatgaaggtgacgcacgaacagatggaggccaggcacagaaatatagaataaagaaaataaaatccatgttgatttcatatgcgtatcctgtaccagcaggggcaaggagtgcttttatatagcgagttctcccaaattaatggttaaatcttcaattcggtttttgtccgtatccacgatccagtaactcaaggacacctcattttacggcaggaatcgccggcaagcccataagactttagttttatgggcttcttcacggttggcagtatagtatagcgggcgaagaaaattaaggaatgtacacaaaatatctacgctacgcctgggaacatgtagagagatgtcttgtgcctttcaaaacggagagtgatatgatataataactgcaaagtgtcaaaaaacgctagtgatattatataggggacaggagggcaggtatgaatatattagtagtagacgacgagaaggaaattgcagatgtgatagaactctatctccagaatgaccagtatagcgtatataagttctataccggccaggaggcgctagactgtattggcagcatgaagatcgatctggcgatccttgatatcatgcttccggatattgacgggttccagatcctgaagcagatccgggagaaatacacgttcccggtaatcatgctgacggctaagacagaatatatggacaagatcacggggcttacgctgggagcggacgactacatccccaagcccttcaatccgctggaactggtggccagggtaaaggctcagctgcgcaggtatacccagtacaatgaaggggccaaagaagaaggagagattatagacttcgggggcctggtgctgaacaggacctcccatgaatgcgtctataatgaaatgccgcttacgcttacgccgatcgagttcgatattctctggcttctctgcgagaaccgggggaaggtgatcagttcggaggaactttttgaaaaagtatggcatgaaaaatattacaagaacagcaacaatacggtgatggtgcacatccggcaccttcgggagaagatgaatgcgcccaccggcaaatctgattttatcaagacggtatggggagtaggttataaggttgaagaataactatcgcaagcttaagttcagcatcctgctgcagacggtttttgtaaccgctgtcacggtgctggtgggcggttttctgctgaactatgtaatcgacggcatctataatgacagttttgccaggatattcgtagatttcctgacttctcttgatgtggaggagaagacggccatagatttatactggaagctgatcggagacaacaagacctttttcatggtcgttggcttcctgcttctttttgccctgtttttctatgtggccttgtctaagatgacgaagtatctggatcagatcggggacgggatcgaaaatatcgtgtcggattccacggagccgattcatctgatcacggagttaaagccgatcgagatcaggctgaatgagattaaggcgaccctgaagcgtcaggaactggaggcggaagagggggagaaaaagaagaatgacctggtaatcttcctggcccacgaccttaagaccccgctgacctctattgtggcatacttaagcatgctggacagccatccggacatgtcgcaggaggaacgggagaaatacacccacattgcatttgagaaatcgctgcgtctgggagaactgatcaatgagttcttcgacattacccgctataatctccagaatattgaactggagtccgtggagatcaacctgtcattgatgctggagcagctggcggacgaactctatggcgtgctgcaagaaaagcagcttgcctgccaggtagatgtggaagagaatctggtggtctacggggatccggataagctggcccgggtctttgacaatattctgaggaacgcgatcgcatactgctatgacaataccaggattcagatcaaggcgcagatgaaggggcaggacgtggagattatctttacgaaccagggagataagattcccggggcaatgcttcagactatattcgagaagttctaccgcgtagatggctcccgttccagcgggaccggaggagcggggctaggactggccattgccaagcagattgtggaattgcatggagggctgatccgtgcaaaaagcgatgacagcaagacgcagtttattgtgacattgccgacaaggacagaaaaggaagaagggacagcagaggatgaagttcatacacatcgcagacgtacatttaggagcaagcccggacgcaggaagcgcgtacagcgaaaagagggcgaaggagatctggaatagtttgaagagagtggtagatgcctgtaataaagagcggacggaccttcttctcatagccggcgacctatttcaccggcagcccctgcttcgggaactgaaggaagtcaattctcttttcgcgacccttaagcatacccaggtggtgctggtggccggaaaccatgattatctgaagaaagattcttattaccgcacgttccggtgggcgaggaatgtgcagatgattctgtcagaggatatctcctgtgtggaatttcctcagctatccctggctgtatacggatgcagctaccattcccgcgagattaaggaggcaaagtatgataatgcatttgccgggaacaagcagaggtatgagattctgatcgcccatggaggggatgagaagcatattccgatacaaagaaataaaataaaggcccttggctatgattatgttgccttgggacatatccataagccgcaggtgttccaggaagaaggcgccgcctacgcgggagccctggaacctattgataagaatgatgtcgggcctcatggctatgttcggggcgagatggatgataaaggctgcagggtatggcttgtgccggatgccgaaagagaatatgtccacatggatgttgagatagacaaggccatgacgggccactcggcgcgggaacgcataaaggcgcagatcaaagagaggggagtacagaatctatataagattacgctgaaggggttccgtgacccggatattctatttgatctgggggacatggatccatatggaaatgtggtagaagtgtcggatgagacaaagcctgcatatgagtttgggaggcttctggaacagaacaaggataacctgctgggaaaatttattgaatcgatgcaagactatggaaaggacagcatagaatatcaggctctgtgcgaaggtgtccaggcgctgatggaaacgagaagaggctagatatgaaaattcgggagttaataattaagaatttcggcaaattttcgaatcaggatattttgctggatgatgggatcaatatattatatggggagaatgagtcagggaaatccacgctgcatgcttttatcagagggatgctgtttggcatggaaagaggacggggaagggcttcccttaatgatacatacagcacttatgaaccatgggagaaccccaattactattcaggagtgctgagattcgaaagtggaggaaagatgttccggattgaccggaattttgataaatattcgaagaaggcagaactctactgcgaggatgacggagaacagctttctatagaagacggggatcttcagatgctgctgggagagcttagcgctgccagttatgacaacacgatatccgtgggccagatgaaggtggagacaggccagtctcttgcggcggaatttaaaaattacgccaccaattattacgctacaggcaatacggagattgacctggaagggactcttcagaatcttaaggaaaagaagaaggcgctggataaggaagcaaaagatgccttggtcaggaagcagcagaaaagagaactcattgagcaggaggcatcctatgtctggcgggatattcaccggctggaagaagagcaggatagcatcacggaagaactgctgcacagggaagagaaggagaagcaggaggaggcttcaggcaaaggagtcatagatgagctgcgcccatccaagtggcggattcatccggtagagatcggactttttatcattttcattatcttggcggtgatcctgatcgccaagccgtggaactacctggttgcgatcgtcattttcctggcctgtgggctgtatgtgtggaaccgcatgaaagaggggaaaaagaaggaaaagactccgccggagatcatactggaggagattacgccggaagaagagaagattcccattgaaaggcttgtatgggaaaagaaccgcgtggaagaagaactgcaggagaagcagatacaatatggaaacttgaaagaccagctgatggaccttgatgaagtcagcgaggattctcagtggattgaccgcaggcgtgctgccatccagatggcaatagaccggttaaacgaactttccggagaactgcaggtgcagttaaaggaggaattaaacaggaaaatctctgagatcatatgccagattacaggcgggaaatatacaaggctcctggtagaggaagacctgcacatgagcctgttgtcgaaagggaagcggattcccatggaacaggtaagccgaggaacaatagagcagatttacttttccttgcggatgactgccagcaaagtcctgcaggaggaggaaaatccggtcatactggatgatacctttgcctattatgatgacgagcggctgaagcgcacgcttgcgtggcttgcaaagaataaaaagcaggtccttatattcacctgccagaagcgggagatccagctgttggaagaactggggctggattatcataaggtgtgcctgtgaaagtcctatgaagataaatacacagaaagaaacctccaaagtagattggatagatcgccgtctctactttggaggtttcttttgcgtaactagatctcttcgcctcttttatatttttccagtacattctggatacgctcgttgggattcagaatgctgctgatggaaccgtcatggttcagtgtatcaatcatcagcgcgatgtatttgctcatctcgcagctgatatagtatggacgctccagaagttccggcgtctgatagatcaggttggtggtcagaatggcatcgatcaggccatcttcgtaggctttgtcgaacttctcgaggccattggtgaacaagccgaaggtggccgcggcaaaaatccgccttgccttgcgctgcttcagctgtcgcgctacatccaggatactgtcgccggaagagatcatgtcatccaggataatgacatcctttccttccacagaagagcccaggaattcatgggcaacaatcggattgcgtccattgacgatcttcgtataatcgcgcctcttgtagaacatgcccatatccagattcagcatgttggccagatagatcgcgcgctcggtggctccctcgtccgggctgatcgccatcatgtggtcgcagtcgatctgcagatccttgaagttgcgcagaagccctttgataaactggtatgtggggcgaaccgtttcaaagccattcagagggatggcattctgcacccttggatcatgggcgtcaaaagtaatgatattgtctacgcccatccgcaccagttcctgaagcgccagggcgcagtccagggattcccggctgcttctcttgtgctggcggctttcatacaagaacggcatgatcacgttaagacggcgggcctttccgccgatagcggcgatgacacgcttaagattctgataatgatcgtccggggacatgtgattctcatgtcctgtcagcgagtaggtcaggctgtaattgcagacgtctaccatcagatagatatccattcccctgacagagtcattgataatgcctttggcttcgccggagccaaaacgggggacctttgcgtctattagaaatgtatcccgttcataaccgtggaaaacgatgtcatccttgtgggcatgtccatcctctttcctccatttgacaaggtaattatttaccttgcctcccatttctttacatccgtcaagggcaatgattccaagcgctcctacaggaatgttgtcaagattacgatcgttacggcgtaacatcttttgtacctcccaggtttaataattttttttggatacggatatcatctccggtaaggcgcagaatcgtatagttactgctgatccgggagaaagtccgctccgaatagatagattttatgtcttccaatgcaagattggtagatataatggttgatttctgccttaagatacgctcattgaggcagataaacaactgcgataccgtaaaagaattcggcagttccgtacccaggtcatctatgatcagaaggtcgcagtcatagatgtgctcgcaggcgtcggagtccttcgcatcttttctgccaaatgcgctctcggcaaatatatcaaagagctgtgtcgcagtaaaatatataacagaaaatgatgcatcaatcaactccttggcaatacaatgagagaggaaagtttttcctacccccgtatctccatataatagtatgttatgaaactctgtggaaaatgtatctatgaattcatgacaggctttcagcgcggtctgtatggcttccagcgaggatcttccggtcagaggatcaatatggttgatggaataaaaccccagagaacaggtagaaaagttctctttgcctaatatttcctgtagatttgactgcgtgtacaaaagatccacaatggccttcttaaaacagtggcactttttcgtgccgatatatcccgtatccttacagtccgggcaggtataatgaagttccaggtaatcctttggcagtccatgggattcaagcagctggtatttgcgttgggacaggctgcggacatcttccttcagagaagaaagtgccccctgattgccgtccagaaggctgcgggccttctctacgcttaaggaggagatggaatgatccaattcttccagagccggaatcagggagtacgctttttcatagcgtctccttaactggtattcattatccagttgtctttgttcgtatgtacgcatcaactgatcgtactgggaattggaaagtgccatattatggtagatctccttattttatcgtgcttactgctgaaccagcttgcgctccaggtcgtccatatcataagagcggccgtcaaaattgttgaatttattattctttgtattgatggcaggcttggcagcctgttttttcttgcgttccttttctctcaggtaatctgcatccagggcttcaatatccttcagataatggacattcttgccaagccagtttttgagaatggtatccgtatactcaaaatttggctgatggatggtgttcatagtacggttgcatgcttctaatataatatccagcgtgaagccatactcctcattccatttgcggatatacgcaatctcggaagtagcgggagcccgtcccttgattccataagcgtttaatacagaatagcagttcttattatataagatcgtgctggacttggccgcctccacggtggtgatcttctggtcattccaggagagggctaccttctggatgtaatgcatgcttttatgcccgttctcgacacagtattcgatgagatactcgatcaactccgccgacatgcgcagcgtatcaaaaaaatatgtaatggtgtcaatatccatggaagacagcgtctttccaaggtattgctctgctacaaaaagcagttccttgaattccttgcgttccttcctgctgcggtactgctgaatgttaggcgcggacgcggagtcatcctgtacatccggcagaggcgcggagtcagccgctatcgcgtcggaggcggcattcttcatataagaagcaggggcggattcggaggcggggagttcttcgcattcctcgcagtagtccagcagtccctgctttttccaataattcagcgcgcggaccacatccttttccgtgcattccagcttatctgcaatctcagaaacggacagcatcccggaaggctcattcatgtggcgcagcagaagaagatacacctttacatattctccatttgctttgaccatatgatggtcaataaattcgttctcaagcacagtggtattgccctgcgcatagttggtaagtgttaatctcttcataattcttacgccagtcctccttgtcagttcgtttctcgtgtatgagttattatagcaccagaaggacaggcgcaaaagaaatttctaagccaaaatccatgttttttgtggataaaaatctgtggaaaatgtggataactaccgctttaaaagttcttcgccaatgtttacaacatctccggcgcccatagttatcaacaagtcccctttttgacacttttctacacaaaaatcctggatgtcttcaaaggaagaaaagtaataggcatcgcatcccttttccttcagcgcatctgcgatatccttggaagagattcccaggttatcggtctccctcgctgcataaatgtctgaaagcaccacgtggtcggcatgcgccagggcctccacgaattcatggaacaaagccttggtcctggtgtaggtgtggggctggaaaacgcaccagagttcccggtggggataatacttggcagcagtcagagtagcattgatttccgttggatgatgggcatagtcgtcgatgatggtaacgccatccatctcgcccttgtattcaaatctccggtcagttccagtaaattccttaagcccctttttcatcgtatcaagggataccccaagaaggtctgagacagcgatggcagccaatgcgttggatacattgtggtcgccattgacggacagagatatccgatcaacgaagacgccagattttaccaggtcaaaagaagcctcccctagtttattatgggagatgtttgttgcgctgtaatccatggaactgtcatctccgtattttataatacggcagtcaagtccttcggtaatacggtccagtttgtcgatatttccattaatgatcaaagttccgtcctttggcagaagtttcgcaaatctgtggaaagaacagcggatatcatccagatccttgaagaaatccagatgatcctcgtcaatattgagaataacgcttatctttggaaagaaatgaaggaaactgttggtgtattcgcaggcttccgtaacgaacagctccgatttccccacctttatattccctccgatcgccttaaggatccctcctacggaaatcgtaggatccatctcgccggccagcaggatatgcgagagcatggatgtggtggtagtcttgccgtgagtgcctgagatggcgatgggaacatcgtaattggtcatcagctgtcccagaagctccgcccggctaagcataggcagcccctttttaatcgcctgggcgtattcctcgttgtcctcatggatggcagcggtatacacgaccacatcaatcccgtcaataatattggacgctttctggccatagaagatggtagcgccctgctgcttcaggtggctggtcagggctgattccttgttgtcagagccggatatggcaaaaccctctttcagcagaatctcagccagcccgctcatgcttatgccgccgattccgataaagtgcacgtgtacaggttgctcaaaattgattttatacataaaataccttcctcttccatatgttctgtttccgttaaaaaaatgtagtcataaatatatatatctttccatattattatatacatatatggaaaaaaaaccaagccgtaactttttgtgatattttaataaaaagttcacgaaaagttcatttaatttgtaaaatttgttcactcaaaatcaaaactatggtataatgtgaactataaaaattactgagaaggggtgatgacatgattaagaaagagatgatagcaatgttgctggcaggaggccagggaagccgattgggagtcctaacagccaaggtagccaagccagccgttgcttttggaggtaaatatagaattattgacttcccactcagcaactgcattaactcaggaattgatactgtgggagtgctaactcaatatcagccattacgattaaacacgcatataggaattggtattccttgggatctggatcgtaatatcggaggcgtaacaattctgccgccttatgagaagagtaacagcagcgaatggtatactggtactgccaatgccatataccagaacttggattatatggagacatttaatccggattatgtattgattctttccggagaccatatctataagatggattatgaagtcatgctcgactatcataaagagaacaatgcagatgtaacaattgcagcaatgccggtgccgatcgaagaagccagcagattcggcatcgtaattacggatgaagacggaaggattaccgaattccaggagaagcctccgcagccaaagagcaatctggcgtctatgggcatctatattttcagctggccagcattgaaggaagcgcttgtggcattgaaggacgagccggggtgcgactttggaaagcatattattccatactgccatgagaagaatgagagattatttgcttatgagtacaatggatattggaaagacgtagggacgcttggctcatattgggaagccaatatggaactgatcgatattattccggaattcaacctgtatgaagagttctggaagatctataccaacagcgatattatccctccgcagtatatttcaggacaatctgtgattgaaagaagcattatcggcgatggatcggaagtgtatggggaagtacataactgcgtaattggttccggtgtcacgattggggaaggcacggtagtcaaggactccattattatgaaagacgtaagcattggcaagggctgcgtgattgacaagtcgatcattgcggaaaactgcgagattggggacaatgtaacatttggaattggcagcgatgtgccgaacaagcttaagccggcagtctattccttcggtcttgtaacggttggcgagaactccgtcataccgggccaggtgcagatcggcaagaacactgccatcagtggcgtaacatccaaagaagactatccaaatggaatactggaaagcggagagacattgataaaggcgggtgagcgagcatgagagcagtaggtattattttagcaggcggaaacagcaacaagatgcgtgaattgacacataagagagcggtggcggcaatgccgatagccggaagctacagggcgattgattttgcgctgagcaacatgtctaattcacatatacagaaggtagcagtgctgacccaatacaatgcccgttcattgaatgaacatctgaattcctccaaatggtgggattttggaagaaagcaaggcggcttgtatgtgttcactcctacgatcacggcagataatgggtactggtacagaggaacggcagatgcgatctaccagaatctggatttccttaagagatgccatgagccatatgtgatcatcacatccggcgatgcggtatataagatggattataacaaggtgcttgagtaccacattgccaagaaggccgatattacggtggtttgcaaggaactggagcctggcgaggatgccagccgctttggaacgcttaagatgaacgaatctatgcggattgaagagtttgaagagaagccgatggtagccaaatcaaacacgatttcaacgggaatctatgtaatcagaagaagacagctgattgatctgattgaatcctgcgcagaggaagacaggcacgattttgtaaccgatatcctgatcagatataagaatttgaaaaagatatacggttataagataaaagattactggagcaacatatcaacggtggacgcttattatcggacaaacatggatttcttgaagccggaagtaaggaattacttcttcaagcagcatccggatgtctactctaaggtgagtgacctgccgccggcaaaatacaatcccggcgcagtggttaagaacagcctggtagcgagtggaagcattatcaatggtacggtagagaattctatcctctttaagaagacgtttgtcggtaacaactgtgttattaagaattcaatcattctgaacgacgtctatctcggggacaatacatacatcgagaattgtattgtagaaagtcgtgacacgattagagccaatacacgtcatgttggggaaaatggtgtgaaagtagttgtggaaaagaacgagaggtatgcactatagtgcagcggcttgtaaagaaaggggctagaggaaaatgcaaatcacggatgtacgcgtgcgtaaagtggcaaaagagggaaagttaaaggcggtagtatcaattactatggatgaggaattcgtagtacatgacatcaaggtcattgagggtgaaaaaggactctttattgctatgccgagtaaaaaagcattagacggggaatatcgagatattgcgcatccaattaattcagagaccagagagcgtatacagagtattattcttgagaaatacgaagaagcgttgaatgaagaggaagaataagaaatcttaagatggacagggtatgcaaaagaatgcataccctgtttttgatttacggcagccaaaaaagcgtctagcctaacaaatgaaacgtcatgtttttgtgggttttgggatgtaagaattccagccgataggcgcacaggcagatgttttgccagcctccggcttcctgtgccttctggttatacttggtatcgcctgcgatggggcagcccatatgcgccagctgcacgcggatctgatgatggcggccggtatccagcctgatatccagttctgtccgtggcgcatcatcgtttggcgcttggtcaaaaaggaaaggtccctgttctacaacggcataatgaagacgggcaagcttggctcctgccgtgccggaagcgcagacgcgggaagtgttggcgcgcccatcctttatgagatagtcctccagcgtgccttctttctgagagggatggccgtccgtcaaagcacggtaatattttgcgaagccatggctctgcagctggcggttcagttcctttgccgcaaaaggcgtcttggcgaataccaggatcccttttacaggctgatccaggcggtggatgaccgccaggtatggctcgcctttttcaggggcagactgatagatatgattcttaacaagactttccatatcgggcgtgcctgcccgcctgctctgggttggaactccgtgaggctttatgcacaccagtatgtgggcgtcctcatataagatttctatgtgcttggtattcatatgaattctccttgactttgcgacttttcactcttatcatttaaacatagtggattaaaatatgcaaatgaaaataggggaaggcagaaaaatggattatttactattaattctgggatttatattattgatcaaaggagcggattattttgtggacggcagttccagcgtggcaaagctcttgaaggtgccaacgataattataggacttacggtagtggcatttgggacaagcatgccggaactgtcggtcagcgtgacggcggctatcaagggaaataatgatctggctgtcagcaacgtgctgggatcgaatatattcaacctgctggtggtgcttgggtgctgcgcgctggtgaatcctgtccgggccaagtggtctttgctgaaaaaggaattcccattttctatttttatagcggtgatactgctgcttctgaattccgatttctcgattacaaaggtcctgagcggggaagggaaatatgttcttggcagatggggcgggctgctctttcttgtactgtttgccgtgttcctgtatgcgacggttaagacggcgctgcgttccaggaacgaggtgatggaggaagaggaagattataaactgcttagtccggcaaaaagcgcgggatatattctggtgggcctggctggcattatctggggaggcgatctggttgtggacagcgcaagcagcattgcagtatcctttgggcttagccagacgttcatcggactgacgatcgtggctcttggaacatccctgccggaactggtgacatccgtagttgcggccagaaaaggcgagaatgaccttgcggtgggcaatgtggtaggctccaatattttcaatattcttctgatactgggagtatcggctacgataacgccgatcgtgctggatattacagcggtctatgacacgatgattctgatcgtggcaagcattatcgtatatgtggcggccatcagcaagcatgaaatacacagaaaagaaggcgtgatgtttctggtcgcgtatctggcattctttatctatgtgctgcttcgataggacaggcttttggcggatttcgtaatattttgggttgacaaatgagtgacaatagattaaaattacgtttaattcaatattatttggcgatgaagaggattagtacatgtaagcgagcctcagagaggagatcatctggtgcaagatttccgcttagaactgcatggaacccgccttggagccactgcatgaaagtgcagcgtcctgccagcgttaatggttaatgagagaactgcgaaagggtcgcagttaactagggtggtaccgccgagcttttcggtccctttttagggagcgaaacagcccggcgttttttgtctgctgcaatcaagctcccgccagtaattaaagtggggcaagggccctgcgagagaagaaaaggagaagagaaacatggcaaaggaaaagaaattagttgaaagcatcacgccacgtgatgaggatttcgcgcaatggtacacagatgtggtacgcgaggccgaactctgcgattattcaagcgtaaagggatgcctgaactacctgcctaatggctacgcaatctgggaactgatccaggcggatcttgacaagcgttttaaagagaccggggtagagaatgtatacctcccaactttgattccagagagccttttggaaaaagaagcggatcatatcgaaggatttgctccggaagtagcatgggttacacatggcggtatggaaagacttcaggaaagattatgcatccgtcctacatcagagacgctgttctgtgatttgtgggcaaagacggttcagtcatatagagatcttccaaaggtatggaatcagtggaataccgtactgcgctgggagaagacaacaagacctttcctccgttcaagagaattcttatggcaggaaggccatacaatccatgcaacatatgaagaggcagaggaacgcacgatccagatgcttcatgtatatgaagactgctacaaggagacgcttgcgataccattcgtatccggaagaaaggcagagcatgagaagtttgccggagcacaggatacgtacaccattgaagcgctgatgcatgacggaaaagccctgcagtccgcaaccagccatttcttcggaagcggattcccggatgcgttcggaatcaagtatgtggataagaacaaccagcttcagagcgtatatgagacatcctggggatggtctacaagaagtatcggcgcccttatcatggttcatggcgatgacagcggactggtgcttccgcctcatgtggctcctgtagaatgccggatcatcccgatcgcacagcacaaagaaggcgtgctggacagatcttttgcactgctggatgaacttaagaaggctggatacagagtgaagatcgatgactctgataagagtacaggatggaaattctctgagcaggagatgctgggaattcctactcgtatcgagatcggaccgaaggatattgagaagaaccaggtggtcgttgtccgccgtgataaccgtgaaaagatcgtcgtatccttggatgagattgcagtgaagctgcgcgacatcttagagcaggagcagcaggatatgtatgacagggcgaatgagttccttcagggccacatcgatactgctacaaccatggatgaaatggttgagaagttcaaggctaaccgtggatttgtcaaggcttgctggtgtggagatccagaatgcgaaggcgaagtgaagtacgccacaggcggagcggcaaccagatgtctgatcgaagatgaggaaatgatttccgataagtgtatctggtgtggaaagccggccaagcatatggcatactggggcaaatcctactaggaaatagagtgcttagaatattaggaactgctgtaccaagagtgaaaaaaccttggtatggcagttctttttttcttggaacagtcttggaatgtcatagatttgttaattcaggaagaaatgtgatatgataggataagctagtttatttggaggatatcgctgtgggagatagaactatacaattgcctgaaaaagtaggcaaaattatcgggacgcttcaggaacatgggtatgaggcgtatgcagtaggcggatgcatccgggattctatcctgggaagggagccggaggattgggatatcacgacatcagccatgccggaagaaacaaaggctttgttcgataagacgtttgataccggcatccagcatggaacgattacggtacttctggaaaaagaaggattcgaagtgacgacgtaccggatcgatgggaaatacgaagacagcaggcatccgaaggaagttacctttacgcgcaatctccgggaagatctgcttcggagggattttaccatcaatgcgatggcatataatgaaacggatggcctggttgatatatttggagggcttgaagatctggaagcagggatgatacgctgcgttggcgacgcgaaggaacgattcaaagaagacgcgcttagaatcctgcggggagtgcgctttgcggcccagctgggattcgatatagaggaggacacccggcaggggatgaaagaactggcctggacgcttcagaatatcagtgcggagagaatacaggtagaattagtaaaaatgattacatcaaagcgtccggaaatggtgcgtgaggcatatgaattaggaatgacgcggatagttcttccggaatttgaccagctgatgacgactggccaggagacgccgcaccataggtataatgtgggcgagcatacgctgcatgccatgaagaatatccgcgcggataagattctaagacttgccatgctgctgcatgatatggggaagccggcgttaaagacggtggatgaagcaggagtcgcccattttaagaagcatgccctggagagcgagagaattgccggaaatgtgctaagaaggctgaaattcgacaatgatacgatacgcaaagtgacaaggctggtccgctaccatgaccttcgtatgcctgccacggcaaaaagcgttcgcagggccatgaaccagatcggggaagaactattcccatattacatggaagtacgccgcgcggccgtgctggcccagagcatgtatcagagggaggaaaagatcgagaatctggatcagatagaagaattataccgccagatcgtggaagatggcgactgcgtatctttaaaggatctggcagtgaccggccgggatctgatcgcctcgggcatgaagcctggcaaggaaattggcgagaaactggaggaattgctgaaactggtcatagaggatcccaaattaaatacaaaggaagaactgctgaaacggctgaattaaagaaaatcccctgcccttaatcatattttctcttttcctgacatacgttagagagaatatgtaatatagagtgcaggggattagtatgcaggaatatgaactaggtgttttagagcagtataatatagaagtcatcagcacccgtaaaaccaggggtgctattttatgcgacacggatcaggggctgcttttgctgaaagaagtgagggtgtctgagaaacgtatccctgcgctgtacgaattgtatgaatatctttatagccagggatatggaagaatagacaggatcatactgaccagggaaggagaatgcctttctgcgctggaagacggcagcagatatatgctgaagtcctggtttaagggccgggagtgcgatgtaaagaaaccggcagaactgcttgcggcatccggcaacctggcgaagcttcatatattgatgcgccatgaactggagagcaatgtgacggcgggagcccatctgaaagatgagtatctgcgccataacagggaattaaaaaaggtgcgtaagtttatgagaggcattgcgcccaaaggagaatttgaattcgcgtttctgaagcattttgaccagatctaccagtgggcggacgcggcgatagcggaattggagaattcggactatgagagcctctaccaggacagcgtcaagaactgctgtatgacccatggcgagtataactaccataatatactgatggtgcagggggattataattacaagaaagagccttaccgcattgccaccactaactttgagaagtttaagagggatgtgcaggtggaggatctgtattatttcctgcgcaaggtcatggaaaaacacggatggaaggaacggcttggggacaatatgatcaatgcatattccgcgatcaggccgattacggatgcggagctggaatatcttaagatacgcctgatctatccggagaagttctggaagattgccaattcgtattatcattcgaataaggcgtggatatccataaaaagtatagagaaactcaatacttccattaagcagacagaagaaaagaagcggtttttagaggacatattttcttttcatttataacttcctgttgtataataaaagcattaaggacaggaggtacgactatggaatatcgtgaaaaatatgagggatggctaagcaatccatactttgatgaaaacacaaaggatgaactaagaagcatagcggaagatgataatgagatcaaggagcgcttctataaagatctcgaatttggaactgccggactaagaggaatcatcggcgcaggaacgaaccgcatgaacatctatacggtcaggaaggcaacccaggggcttgccaactatattatgaagaatggcggtcaggcgaaaggcgtggcgatcgcatacgattcccggcgcatgtccccggagtttgcagatgaagctgcactgtgccttgccgctaacggaatcaaggcgtacgtgtttgaatccctgcgcccgacgccggaactttcttatgctgttcgctcccttggatgcatagccggaattaacattacagccagccataatccgccggagtataatggatacaaggtatactgggaggatggcgcacagatcaccccgcctcatgacaagggaatcatggctgaggttgaggcagttacggattataatacggttaagactatggggcttgaggaagcaaagaaggccggactctatgaagtgatcgggcaggaagtggacgatggctacattgcagaacttaagaagcaggtgatccatcaggactctattgatgcggtaggcaaggaactgaagatcgtctacagtcctcttcacggtaccggaaatataccggcaaggcgcattctgaaggaactggggtttgaaaatgtatatgtagtaaaagaacaggaattgccggacggagaattcccgaccgtttcctatccgaatccagaggcaaaggaagcctttgaacttggacttgcgcttgccaaagaagtggatgccgacctggtgctggctacagacccggatgcggaccgccttggagtgtacgtaaaagatgccaagtcaggagagtacaaggtgcttaccggcaatatgtccggctgcctgcttgcagactatgagatcggccagcgcaaggaagtcagcgggcttccggatgacggctatctcattaagacgattgtaacctccaatctggcggacgccatagccaaaggctacaatatcgggcttatcgaggttctgaccggctttaagtatatcggacagcagatccttggattcgagactacggggaaagggacatatctctttgggtttgaagaaagttatggctgcctgatcggaacccacgcaagggacaaggatgcgatcgtagcgacaatggccctgtgcgaggctgcggcttattataagacgaagggcaagactttgtgggacgctatggtggacatgtatgacaagtatggctattacaaggatgatatccagtctatcacgcttaaaggtatcgagggtcttcagaagatccaggaaatcttagagactctgcgtaagaacccgccgatggaagtaggcggatacaaggtgctgaaggtaagggattaccaggctgacacgatcaaagacgtggctacaggcgatgtgacgcagaccgggcttccaacatccaacgtcttgtattatgatctgacggatgacgcctggctgtgcgtaaggccatccggtacggagcctaaggtaaaattctactatggaatcaagggaagttctcttgcggatgcggatgaaaaatcaagcaagcttggagaagaagttttatccatgatcaacaccatgatgtaagccagggaaaaagtgggaaaaccctgaaaatacgggaaaaactgagaaatcaccttgacaaatacagggaaaacaggtataacagtaactaaaggcatgccatatgagcgtatggggagccgaataatttgtagaattgaaaataagggattctatacgtaaacaagaggaggaaattatccatgaacaaaacagaattagtagcagcaatcgctgaccaggcagaattatctaaaaaagattctgaaaaagcattaaaggcttttattgatgttgtaacagatgaactgaaaaaagatcataaggtacagttagtcggctttggcactttcgaagtaagcaagagagcagcaagagaaggaagaaatcctcagacaggaaaaaccatgaagattgaagcatgcaaggctccaaaattcaaagctggaaaagcattgaaagacgctgttaacgcataattcggcgaacggataagttttataaaggtataaaaatagagagcgccttacgctctctatttttatgtctggaaggaggatgttatgagactggacaagtttttaaaggtttcccgcctgatcaagaggaggaccgtggcaaacgaggcctgcgatgcaggaagagtgacggtcaatggaagcgtggcaaaggcctccgtgaaggtaaagccaggagatattattgagattcaatttggaacgaagacggtgaaggtggaagtgctggatatacaagagactacaaaaaaggaagaagccaaagatctattcaaatatttgtaataaatggaaacaacccttcataagataattaagaaaggttgtgatgcgcatggaagaaagaaccgtacaaaaaaaccataaactggtgatcaataaccggaaaaccagccttgttacaggcgttatagatgtgctgtcctttgacctgaatgagattctgctggagacggagcagggaatgatgatggtgaaggggacagatctgcatgtcaaccgcctgagtctggaaaaaggggaagtggacctgtcaggaaatatagacagcgtggcatattcggatgtccaggcgcatggcaagcagcaggagaacatattctcgaaattattcaggtgattgcatgccaggactgaaagaagaattaatggtgtttgtgatggcggtgatatccggcgccatcgtgcggctggcctaccgctgtatcgcctgcttccggaatatcataaggcataatctcgcagccatagggatagaagaccttattttctggatcggctctgccatctatatctttgtgcagatttaccatacaagtgatggtagtataaggtggcattttgtactaggtgttgtgctgggggcagttttgatgacggtttttttaagacagttggaaaaagtgtacaaaaaaatctacacgcgtaagaagaaggattttccccaaaagtcttgattaaaagaaggaaaaaagttaatatattattattaattgggtgagtatagccggcaggggtgccggcgtaagggtgagtaattatatgaatggaattaaacaaaagagccgtagaaggcggcagaaaaaacgcatacagcgacataagagaagcgtgctggcggtcagcgccgtaattcttctgctggtagtggtagtatccgcgagcagcatgacgctccgcgcaagagataagtcctatcaggcacaggagatggagctgaaggagcagataaaggaagagacggcacgcaaagcagagatcaaggatcttgagaagtacgtgggaacagatgaatatgtagaagatgttgccaaagacaaactaggtctggtacatgagaatgagattatatttaaggcaaaataaacagatgataagctttaggaagtaggattcctaaagcttttttctttgtctgggagaaatttgtctaataaccattgaaaggggagcaaagaatggcggaggtaaaagagaaagagacttttgtgaatccttatgtcatacagatggacaagtttgcggattcgctgatgcatctgtcaaagacatttctgacactggaggattataaggggacctttaccaaagatgagattgaggagatgttcctgaagattacggacaaggtctgcgagaactgtgaaaagaaggagtggtgcatgggagagaaccgggtccatacctatcagatgctgtatgagattctatgcgccgtggaagaatatggagcggaactgaatattgaattaaagcggaaactgcagaagaaatgcatcatggcgcccagattcttaagggagacgctggaagtattcgagaatgcgaagcagatcttgatgtggaacaacaagatcgtccagaaccgggaaggatatgccgtgcagctgaatagttttgcgaagatgatccagtataccaccagggaactggatgcgggcatattcgaagatgaacatctggaaaaacggctgaagaatcagctgaagaaatgcggggtaagaatgctgtccgcagtattctatatgacgccccagggaaagtatgagattcatctgacggtgaaggctatgaagggacaccttatagccaccaaggagtttgcggcgctggtcgggaactgcgtgggaagaatcatgatgccggaacaaggagaacggcccatcattggggaagagtactgtacggtcgcgtgcgtggagggcgccagataccataccttgcagggcgtggcgaagatcgggaaaggatgcgagaagatctccggggatacgtttttgatgacggaccttccgggtggaaagaaaggcatcgccttatcggatggaatgggatcgggcgaagaggctttccgggaaagcacgatggtggtagagatgctggaggaactgctggaagcagggttccctgtaaagacggccgtccagatgatgaatacggctctggtgatcggcagagaagaagtgcgtttttccacgatagacgtcagcctgtttgatttgtatagcggtacctgcgaatttgtaaaggccggtgcatcaaccacatttatcaaaaggaaggacgcggttgagaagatctgttctacgacgctgccaatcggggtccttcaggatattgagattgatacggtgacaaagagccttgggtccggggactatgtgatcatggtgacggatggcatcatggacgcgttgcctgtgggagagcaggatgcgctgatgagcacatttatactggattctaatattgtcaatccaaaagagatggcgcatcatatcctgggacaagttctggaatggaccggggaagtacccctggatgatatgacgatattggtagtaggaatgtggaaactgtaaggagaacttgctttttaccgggaaattctatatatttaagtggaacagatgaattactaacataagaaggattatgatatgtatcataaggtaaaggcgtatatagagaagtaccatatgctggatgaaaaggataaggtgattgtaggcgtatcaggaggagcagactccatatgccttcttttcatgctcatcgaattgaaaaaggaaatgggcctgtctgtggaggcggttcatgtacatcacgggctgaggaaagagaccgcggatgcggatgcggcctatgtaaaaaaagtatgcaaagagttaggaatcgaacttcgcttattttatgaagatgtaaaatcctttgctttgcataataagatgagcgaagaagaggctggcagatatgtaagaaggcggattttcaaggaggtcctgaaggaagcgggagggaccaagatcgcgcttgcccatcaccagaatgataatgcggagaccttgctgtggaatctgtgccggggatgcagcctgaaaggaatgggggggattgcgcctgtagacggcgtatttattcgccctcttttgtgtctaaagcgggaagagattgaatcatatctggtgaatcggggaatatcttattgtacggatgaaaccaatctcgaggatggccatacccggaaccggatccgcaaccacgtgataccttatctggaagagcaggtaaatgagagggcggtttcccatatgtcggagactatggaacagatgagacagctgtggaaatatgtagagtcagaaactacgcgttacgctgccagatgcataaaggtgtcaaaggaccaaacgaggagggtacttcttaagcaggaattcatccttgtgcccgaggcgctgcgctcctatgtgcttcatgaatttatatgccaggcggccgggaggcgcaaagacattgagtcggtccatgcaaagatgctgtttgaactgctggataaccaagtgggacgccaggcaaggctcccctatggaatcgtggcagtgcgaagctatgagggaatcgagcttcgcagggaaagcgagggacgcccaaaagaccagaatctaacagaccagaatccggaagggcttatgaagatgcgaacgcttaagagaacgccggggaaagtaatatttccggaaaacccctacacgaaatggtttgattatgatataataaaaaatactgtaaaaatcaggcatagggagccgggagactatataacgattgataaaaacggcaaaacccagaaactgaagcagtattttattaatgagaagattccacaggaggaaagagaccggatctggcttatcgcggatgggaaacatatcatgtggattgtagggtacaggcagaaccagcagtatcagatcacagagaataccagaaggattctggaaatagaattttgcggaggatgaaaagatggcagaaacagttagagtattgattgaagaggaagaagtcgcgaagagaattgaggaactgggcaaaaagatcagcgaggattatgcgggaaagcaggtacacctgatctgtgtcctgaagggcggagtattctttatgtgcgaactggcaaaacggatcagcataccggtttccatggactttatgagtgtcagcagttatggagacggcacgtcgtcaagcggcgtggtaaagattgcaaaagacctggatgagacgctggaaggaaaagacgtgctggtagttgaagatattattgattctggaaggacgctgtactacctgcttgacatcctggccaagaggcacccaagcagcatgaggctgtgcacgcttcttgacaagccagagagaagagtgcgcgatgtgaaggtagactacgtgggattcgagataccggatgaatttgtcgtaggctatgggcttgactatgcgcaaaaatatagaaatctaccatacatcggggttgtagaaggtgtggagtagaaaggggctataaaacattgaatgacaagaagaccagagggctgagcggagccacggtgctgatattcgtagtgtttctgtttgcagcattgtggttcacgaatcagtttgaccaaaaagataaagaattgacatggaaggaatttgagaagcttatcgtcagcgataatgtggagactgttaccgtcagccagaataaaaatgttccgacgggccgggtagagatccaggtggatacaaagaatgatgaagattccgtaaagtatctgtatgtatccgatgtcaatgagattcagaattacctgaaggaaaagaagattgactacgagatgccggatgtgccgcaggacagctggtttgcgacgacgatcgtgccgatgcttctggttctgggaggagttctgctgatattcctgctgatgaaccgtcagggcgggggagccaacgccaaggccatgaactttggcaagagccgtgcaaggcttagcacggatgtggaaagaaagatcacattcggacaggtggccggcctgaaagaagaaaaggaagaactggaagagatcgtggactttttaaaggccccgaaaaaatacatccaggtaggcgcaaggatcccgaagggagtccttctggtcggccctcccggtaccggaaagactttgcttgcaaaagcggttgccggagaggccggtgttccgttctttacgatctcaggctctgactttgtagagatgtttgtcggagtcggcgcgtcccgcgtcagggacctgttcgaagaagcgaagaagaatgcgccttgcattattttcattgatgagattgatgccgtagcgagacgccgcgggacgggaatgggcggcggacatgatgagagagagcagacgctgaaccagctgctggtagagatggacggattcggcgtaaatgaaggaatcatcgtaatggccgctaccaaccgtgtagatatcctggatcctgcaatcctgcgcccaggccgctttgacaggaaggttatggttggccggccggatgtacagggacgggaagagattctgaaggttcatgcgaaaggaaagccgcttagcgaggatatagatcttaagcagatcgcgcagacgactgccggattcacgggagcggatcttgaaaatctcctgaatgaggcggcaatcctggcagctaaggaaaacaggatatacctgaagcaggaggatattaagagatccttcgtcaaggtagggatcggtgccgagaaaaagagcaggatcatatccgataaagaaaagcgtatcacggcattccacgaggcgggacatgcgattctgttccacgtgctgccggacgtagggcctgtatacagcgtttccattattcctaccggcggggcagggggctatacgatgccgcttccggaaaatgatgagatgttcaatacaaagggcaagatgctgcaggatattacggtagcccttggagggcgcgtggcggaagaagaagtatttgacgatattaccaccggggcttcccaggatattaagcaggcaacaggcctggcaaaatccatggtgactaagtttggaatgtcagaggccgttggcctgatcagttatgatgacgacagcgacgaggtgttcattggacgtgacctggcgcatacatccagaggatacggggaaggcgtggcgactgtcattgaccaggaagtaaaaagaatcatagatgaatgctacagcagagcaagacatattatcacgaaatacgatgatgtgcttcactcatgtgcagaacttttattagaaaaagagaagatctcaagagaagagtttgaatcattatttactggggaagtgtctgaggcataatgaaaaaataatgaattagagagggtttggttgcatgaaggaacaagctttgttttgtgatgggactgccagttatgtcaatccgccgcagccggcggagaatgagacaataacgctgcgctttcgcacagcaaaagatgatgtagatcgggtgcgcctcatgacgggcgttggcggatatgatatgaagaaggaaagcaccagaggagaattcgactactacacgatcaactggcgtttgaatgaggagcctttccggtattgctttgaaatccaggatggtgacgagctttgttattacaacaagtgcggcacatcaaaagaaattgttgcattttatgaatttgtcattgtaccaggattttctacgccggattgggcaaaaggggcggtaatgtatcagatttttacagaccggttctataatggcgacaagaccaatgatgtagagtccagggagtatttttatataggagattacagcaggaaggtaacagactggaataaatatccggataagatgggggtgcgggagttctatggcggggatctgcagggagtgatcgataagctggattacctgcaggatctgggcgtggaagtcttgtacttcaatccgttgtttgtctcgccttccaaccacaaatacgatattcaggattatgattatatagacccgcattatggggtgatcgtggaagatgggggagaagtcctggcagaaggcatgacggagaaccggcttgctacgaagtatcagaaaagaacgacggatcttaagaatctggaagccagcaaccagctgttcatcaagctggtagaagaacttcacaggcgcggcatgagaatcatccttgacggcgtgttcaaccattgcggctcatttaataaatggatggacagagaacgcatttatgaaaatcaggaggattatgagccaggagcattcatttccccggacagtccttacagaagctatttcagattctttaaggaggagccgggaaattggccgtacaatactaactatgacggctggtgggggcatgatacgcttcccaaattgaactatgaagattccatgaaactggagaattatatattatatattggaaggaaatgggtatccccgccgtataatgtggatggatggcggctggatgtagcagcagatctggggcgaagcaatgagtacaaccatcagttctggaagaaattccgcgaggcggtcaaggatgccaatccagaggcgattattcttgccgagcattacggagatcccagcgactggcttcagggcgatgagtgggatacggtcatgaactatgacgcctttatggagcctgtaacatggttccttacggggatggaaaagcacagtgatgaggcgagagaagaactgcggggcaatgcggataactttgtgggctccatctcccatcatatgtccaatatgctgacgccatccttgcaggtggcgatgaacgaattatcgaaccacgaccattcacggtttttgacccgtaccaaccacatggtcggaagggtagagcatctggggccgaaggccgcggaagaatatgtaaatgaggcgatcatgcgggaagccgttgcgatacagatgacgtgggtaggggcgcctaccatctactatggagatgaggcgggcgtgtgcggattcacagatccggataacaggcggacatatccctggggaaatgagaatcaggaactgctgaatttccataaggagatgatacggatacacaaggaacatccggcgcttcgtacaggctcgcttaatatactgagctgggatgaaaatgtgctggcatatggacgtttcctgggtgaggaccgtattgtagcaattattaataaccggagcgagcttacagaggtcacggttccggtatggcaggtggaagtgccgatgaaatgccggatgaaaaggctgatctattcttattcagacggctacacgatagaagacgaagaatatctggttgacgacggagaagtcgttgtaaatatgggggcgcattctgcgctgatactgggaatgaaagaagcttgaggctcattaaaataacctggaagaagattatggaaaatattaccataatcttcttttgcttttatcggttatcatagatgaaaaggcaaggaggaggaaatgggtaaaaaaacatatggttatgtgcgggtatccagccgggatcagaatatagaccggcagatcgttgcaatggagaagattcccatccgcaaggaggacatctatatagaccggcagtcaggcaaggactttgacaggcccagctaccgccggctcttgaatctattaaagcccggggataccttgttcgtgaaatcgattgacagactgggaagaaattatgatgagattatcgagcagtggaggactcttacaaaagcgaaggacgtggacatcgtagtgattgattttccgctgctggacaccaggaatcatgtgaacgggctgactggcaaattcatatcggatctggtactccagatcatgtcctatgtagcccagattgaaagggagaatatccggcagaggcaggcagagggaattgcggttgcaaaattaaaaggggtagcatttggaaggccgaggaaagagataccggaagaattcccggatgtggcgaggctttgggagaataaccagatcagcatgagggaggcggcaaggaggcttggaacaagccatagcatgtttgcaaagtggatttcccaatgccaggatgaaaaggagtgttaaaatttggcagattatgtagacttttacatccattgttttcggcggcctaatgcctctcttgttacttatatatatacaaactgctattaaaaatataacattagtggattaaaaagtctgatttttagtccatttttttgttggataatggaatgaggataaatatgacgccaaaaagaaagaacttagaattaattgaattattggcagaacaggcaggctgcacatacctgtcggatttgcagcttgaggaataccgctgcaggctggaaggctgtctccagaagatggatatagaacgctatggagaggaagagtgggcggatgccgctaattacctgacaggtattcccaaagaagaaattgctacgaaggctcaggcaaggcgattgattcttgaaaaatgcagaaaagaataaagaagaactgaaggcatataaaatacacgcttcagttcttctttttattttgtcataacctcgacacccgtctcggtaatcaataccatatactctatctgcgctgacagcccatcgtcgatggtgtagacggtccagccattttcctcgtcaatatagaattcagggcttccctcgttgatcatgggctcgatggtaaacatcatgcccggcacgagcaccatctcgctgcccttgggggttacatagctgacataaggatcttcatgaaattccaggccgattccatggccgccgatatcttccacgacagaaaagccattcttcctggcatgggtactgatggcataagcgatatctcccaaatgtccccatggctttgccgcctttaagccaagctccacgcattctttggtgactctgacgatcttctcggcctcaggggatatctgtccgatggtaaacatccgggaagcatctgaataatagccattcagaatggtggatacatccacattaatgatgtcgccctccttcaggatctcgttttcatcggggattccatggcatacgacattgttgacggatgtacatacgcttttgggaaatccctgataattaaggggcgccgggataccgccgtgctgagtggtatagtcgtataccagccgatcaatctcttccgtactcatgcctttacggatatgggctgcaacatggtccaggactgcagtattcaagtccgcgctttcctgaattgccttgatctgctccggcgtcttaagcaaagagcgatccggaacaatctgtccctttgcggccaaggtccatagttttacgtctagtttatccacaatattacctaccttcttctaaaaatatccatatgtttcattatatcatccctgtcaatggggttgtttgttaattgaaaataagttataattttattatattatgtgctagttgcgggcatgaatataagtttgaaatatagaaaaatgtttggctgtgaaaggagtggacgtatgttaagaataggaatgcttacaagcggaggagactgccaggcgctgaatgcggcaatgcggggcgtagtaaaaggaatctgctctaaaagagatgatgtggagatctacggatttcaggaagggtataaaggactgatctattcgaatttcaagatgctgacttccagggacttctccgggatattgacggttggcgggacgattcttgggacatccaggcagccattcaagctgatgcgcgttccggatgagaatggccttgataaggtagaagcgatgaagcatacgtaccacaagctgaatctggactgccttgtcgtcctgggaggcaatggaacgcataagactgcgaatatgctcagagaggaaggcctgaatgttatcacgcttccgaagacgattgacaatgacttatgggggacggatatgacctttgggttccagagtgcggtggatatcgcgacagataccattgacaggatccatacgacagccacatcccacagccgggtattcatcatcgaggttatggggcacaaggttggctgggtaacgctccatgcgggaattgcaggaggcgcggacattatattgctgccggagattccatacgacatcgatgtggtggtggaagcgataaataagcgcaaggctgcgggaaagaagtttacgataatcgcggtggccgagggcgcgatatccaaggaagacgcgaaactttccaagaaggagctgaaggaaaagaaggcgaagcagaaatatccttcggttgcctatgagatatctgaaaagatccagaagaagacagaccaggaggtgcgcattacggttcctggccatacgcagcgcggcggctcgccctgcgcgtatgacagggtgctggccacgaggcttggagcggcagctgcggaagccatactggatggagactttggctgcatggtggctgtaaagaacagggatattgcccgcgttccgctcagcgaggtggcaggcaaattaaaatacgtggatccggaatctgatattgtcagggaagccaagatgacaggaatcagttttggagacaaataaagcagacagggagtgtaaaaaatgtcatatacggcattgtaccggaagttccgtcctgacgaatttgaagacgtaaaaggtcaggacgccatagtgaagacattaaaaaaccagataaaagcagaacggattggacatgcgtatctgttttgcgggacaagagggactggaaagacgactgtggcaaagatatttgcgaaagcggtaaactgcgagcatccggtagatggaagcccatgcggggaatgtgccatgtgcagatcgattgccgcgggcacgtccatgaatgtgatagagattgatgccgcgtccaacaacggcgtggacaatatccgcgagatccgcgaggaggttgcgtaccggcctacagaaggaaggtataaagtctatattatagatgaggtccatatgctgtctataggagcgttcaatgcgctgctgaaaacattggaagagcccccggaatatgtgatatttattctggccacaacggaagcccacaagataccgattacgattttaagccggtgccagcggtatgatttcaagagaatatcgattgagaccatatccgccaggctccgggaattgattgacaaggaagagtgggaggtggaggaaaaggccgtgcgctatattgcgaagatggcggatggctccatgagagattccttaagcctgctggatcaatgcgttgccttctacattggcgagaaactgacctatgaccatgtgcttgaggtactgggagcggtggatacggagacgttcagcaggctgcttcgggaactgctttccatggatgtgcataaggtaatagagacggtagaagaactggtgatgcaggggagggaactgtcccagctggcatcggatttcacctggtatctgcgcaacctgctccttgtaaaaagttctgataatatggaagatgtgctggacgtgtccacggaaaatctggcccagttaaaagaagaggcccagatgattgacaatgacacgctaatccggtatattagaattttctcggaccttaccaatcagttaaaatacgccacccagaaaagggtactgctggaggtaacgctgataaagttatgccggccggccatggaccagaatcaggatgcgcttctcgaccgaatcaggctgatcgaaaagcagctggaagaaggactttcagacagcgctgtaaaggaaaaagtagtctatgtcaactcggatggccctgcagaacagaaagagaagccaaggcccgaactacccaaggcgctaaacgaagatgtaaaggcagtggcccaggacttccgctctatcgccaatgacgcgtcgccgcttcttcggacgtatttgaagaaagccaggctaagcccgggagagggcagccgcctgctcatcgtacttccagacgaagtaagcgctgctgcggtggggactgcggagcataaagaagagatagagaggctcattgaagaaaagataggaaaacaggtcgatatagaagtccggcagctggaagaaggccgaaggtttgaggacagtttcgtggatcttgagaatttgatccatatggaaataacaatagaagattaggaggatatgaagatggcaaaacgtggaggatttccaggaggaggaatgcctgggaatatggcaaatctgatgaagcaggcacagaagatgcagcgtcagatggaagaacaggcaaaagaaatggagacaaaggagtttactgccactgccggaggcggagcagtagaagtaacggtatctggaacgaagaaggtattgaaggtcaagctggatgaggaagccgtagatccggatgacgtggagatgctggaggatctgatcgttgcggcggtgaatgaggcgatggataaggtggatgaagtgtccgcgtcagccatgtccaagttcacaggcggcatgggcggacagatgcctggattgttctagcagggagcgtaggaaatggattattacagtagccagatgagcaagttaattgaagaattgtcatgcctcccgggcataggttcaaagtcagcggcaaggctggcttttcacttgatacacatgcccctggatgacgtaaaaaggctggcgtccacgatggtcgaggcgcgggagaatgtcagatactgcgcgcagtgctatacgctgacggatcaagaactttgtcccatctgcagcaacagcggcagggatcacaagacgatcatggtagtagagaacaccagagatctggcagcatatgaaaagacaggaaaatacaacggcgtgtaccatgttctgcatggggcgatctcgcccatgcttggcatcgggccggaggatatcaagttaaaagaactgatcgagcgcttgcagggggacgtggatgaggtgatcatcgccacgaattccagcttggaaggggagactacggctatgtatatcagtaagctgatcaagcctacaggaatcaaggtcagcaggattgccagcggcgttccggttggaggagacttggagtatattgacgaagtgacccttttgagggcgctggaaggcagaacacagctgtaaatgcaaaaggggacaggcaatagatagtggattggcctgtccccgttgaggtgataagagagaatgggaaagaaaaaagttacatctacagatatcgcaagggccgccggagtatcgcaatctacggtctccatggttctgaataaaaagtataatgtatctttttcaaaagaaactgtggaaaaagtcgagaatgctgcgaaggaattaggatatgtccccccaaagcgcaagacgaaaaaaggtgccaggcaggagaaacttttggtggtcttttgttccaaccttacgaacccttattatgtcatgctgcttcagggaattgagtccagggcaaaagagcagggattcggcctctttgtctgcaatacccagagagacttgagaatggaggagcggtatcttaaaatgatgtgggaactgcgccctctgggaattatttacacctgcaacccaagccactgctttatggacctgctgaaagaactgtctgaaaagattccggtggcagtcattaacaaccagaatgagaagatgaatgtggatgcagtggaactggacaactccaaactgggaagaatcatggcacgccaccttctggaacttggccatcggaaggtagcctatatcgcgccacctcttacagccaggcagaagcagcgctccaagcgcgtggaaggattcctgaaggaatacgagcaggccggactcagggatcaggtgattatcaaggccgcgagggaagagttcgaccaggatgtggcccacattgattcggaatataagatcggctatgatctgacatgcgagcttctgcaggagaccagggatattacggcgatcgcgggactcaacgatatgatcgcctttgggattatggatgcgctccatgaggcaaagataaaggttcctgccgatatgtctgtcatgggatgcgataatacgctgtttgcccgtatgcacaaggtggaattgacgaccatcgagcattttgtcatatttaaagggcgggacgcctgtgatattattatgaagaagatagcctcccaccacacccagtattcagagacccctcccatcagtacttaccatgtagagtatgagccaaagctgatcgtgcggggaacgaccgcgtatgccaaagggaaaaagaaaaaataaaattaatttattccagagaattattattaataatagaatagaaagatagtaaaaggaattgtaaaatcattggaataaaaaatattttaaagaaaatcaaaagaaaaattacttgcatgtaattaataaaagaaaaatattaatagaaaaaattattaataaactttatgcgctattgaccaaacttcatcctataagttataattctagcatgtggcaaatagcggaaagtgaagggattcacggaatttaaaggaggaagaaaaatgaggtttttcattgacacagccaaggtagaggatattaagaaggcaaatgatatgggagtgatctgtggcgtaaccaccaacccatctctcatcgcaaaagaaggaagagtgttcgaggaagttatcgcggagatcgcgtctatcgtagacggaccgatcagcggagaagttaaagcgactaccgttgacgccgaaggcatgattgcagagggaagagagattgctaagattcataagaatatggtagtaaagcttccgatgactgttgaagggctgaaggcatgcaagcagttgacatccgagggaatcaagacgaatgttacattagtatttacggccaaccaggctctgctggcagcaagagctggcgcaacttatgtctctccattccttggacgtctggatgatatttccgtaagaggaacagatctgatagcggagatcgcgcagatctttgatgtggcaggaattgagactcagattatagcagccagcgtacgtaatccgatccatgtaacagactgcgcgctggcaggagccgatatcgcgacggttccatatgcggtgatcgagcagatgacaaagcatccgctgacagatgcgggaattgcaaaattccaggctgattataaagcggtatttggcgaataatccatcatacagacaggaggagcatcatgaacaaattagagttaatgaagactgccaatgagatccgcaagggtatcgttacggcggttcacagcgctaagtccggacatccgggcggatctttatccgcagcggatatctatacatatctgttttttgaagaaatgaacatcgatccgaaagaccctaaaaaggcagaccgcgaccgttttgtattatcaaaaggccacactgccccgggatattattcaactttggcaaacagaggattcttcccggtagaagaccttaccacattgcgcaaagtaggatcttatcttcagggacacccggatatgaagcatataccaggagtagacatgtcaagcggctcgctgggacagggaatctccgcggcagtcggaatggctatctccgcgaaattatccggagatgactaccgtgtatatacgctgcttggagacggcgagatccaggaaggacaggtatgggaagcatccatgctggcagcgcaccgcaagctggataatctggtagtcatagtagacaataacaaccttcagattgacggagccattgatgaggttaactccccatatccgatcgatcagaagtttgaagcatttaacttccatgtgatcaatattgatggccatgactttgatgcgattgacgctgcctttaaggaggccagggccaccaaaggacagccgacagctattattgcaaagacaatcaaaggaaaaggcgtttccttcatggaaaaccaggcttcctggcacggcgcggctccgaacgacgagcagtatgcggttgctatggcagacttagagaaagtaggtgaagcattatgtcagaagtaaagaagattgcaacaagagaaagctacggtaatgctttggttgaattaggaaaagcccatgaggatgtcgtagtactggatgccgacctggcagcagcgacaaagaccggaacttttaagaaggcttttccggagcgtcatattgactgcggtattgcggagtgcaatatgatcggcgtggcagcaggaattgcggctaccggcaaggtaccgtttgcgagttctttcgctatgttcgctgcaggacgcgcattcgagcaggtgcgtaattctgtaggctatccgaaactgaacgtaaagatcggcgcgacccatgcaggaatctccgtaggagaggacggggcaacccaccagtgtaatgaagatatcgctttgatgcgtacgattccggggatggtcgtaatcaatccatccgacgacgtagaggcgaaggcagcggttgaagcggcttatgaacatgtgggacctgtatacctgcgtttcggaaggcttgcggttccggtaatcaatgatcatgcggattacaaattcgagcttggaaaagcgatcacgcttcgcgaaggcacggatgtgacgattatcgcaaccggactgccggtatctgagtccctggcagcagcggaaaaactggcagccgatggaatcagagcggaagtaatcaatatgcatacgatcaagccgttggatgaggaggctgtcattaaggcggctgccaagaccggaaagatcgtgacggtagaggagcactccatcattggcggactgggaagcgcggtctgcgacgtggttgcagaaaaagcgccggcaaaggtaatgaagattggaatcaatgatacttacggagaatcaggcccggcagtagaattgatcaagaaatatggcctggatgcagacagcatctatgaaaaggtaaaagcatttgcgaaataattgataggtgatagaaaagagcacatcctgcgaagggatgtgctctttttagcgcatgtcgtctgcgaaatgattgcggagcaggtcgtcaggactgacgccaaaaaagtcagccagcgccaggacttcgtagtcgggcacgaatcgtgtcccctgctcgatccgcagtacggtcagatcattaaagtcgtaaccccttaactgcagctgtacggctaatgccttctgagtaaggttgcggcgcttgcgtaaggattttacagaagggcctatgatattctttgttgttccattccaatatattttcatgctgtcaacactcccccggagaatagtcgaaacttctaaagatgaaagattattattgataatatcccaatatgttgataaaatacttctaaagatgaagtttgaggggaatgaaagagttgctatgtatgaaatgataatctattgctatgatgaatgcggcaggccaagcgaaattgttaattataaaaaaataacgaaacctctggcagacgatggatcagagttgagacaaatagaacatttgacgggaatcttggaagatatagagaagacattctgcgggaaaagacgggataagaaagtgctgatcatttcacagaaagggaaggaagagatctttagagaagaagatatcctgtatatagagagaaaaggaagagaaaccagaatctatctcagggagtcggaggttttggttacgagccggctggaagaattagaagaacagcttgctgatacggatttcgttagatgccataaaagctaccttgtaaatctagacgagatacgacagtttcgcagaacggaatttgtaatgagaaatggagagaggattcctatcagccgaaatttccaggagactgtaaaaactaaatttatgaactgggcaaaagaaaagagacagaaacgttgataaaaacagcaggaacttggacagttgtgcagaaatattgaaaacgcgccaaaggtcggataagatgaagcagtattaattaaattccaggaggatgcaaggatgaagaagaggaaaaggataaaattaatgctgtgtatggcatttttgcttgcgatgacgaacgtgctgggagtctgtgccgaagagccggacgttgaggacaagcctgcgctgtcgctgagcgtggaaggcataccggcggagccggaggtaggacagaccttcgaacttactgtaaaaattaaaaacgacggcgcgcaggaagcatcccttgacggctacgagctggtctacaggggagactatgcgggagatattatggatctgtctttcaaaacctatacagaggctgacaagatcgccgcaggcgcgacaattgaagagaaggtagcctgccatctccctgatacgctgtatctgtatggcgagactatcactggctatatcgcattgagcaaagattatatatatgagcctatgcaggaaatttccatgacagtctccagaaagggagagcccgcagaacttacggtaggattctcgaccgatattaaggatggcaagatatatacagatgaagtatatccgtttagcatgacggtaaagaatgaatcagatactgtcttgagacaagtttccatagatgtctctttctttttcgatggaggcaccagcgaatacgatcaattatcttttcagggaaaagagggactgaccatttatgataatttggaaggcaggcttcaatttgcagagattgataagctggatccgggcgaaacctttacgatggagggcgccttcaaggttggagatgtagaatatacgcagataggcctgtatgcaggcgcctttgtctgggatgagcaggcgcagaagtctgtggcatttggctcctatgtgggtgatgcgcttacggtcgtgcggggaaatgcaccgaaggaggagaccggcggcaacacgccatctggaaatggcggggctgcggtcgatacaaatacgccgaatactccggcaaaagaaacggcagagccagagattcagccagtatctacggcaggaaaggttaagacaggagatacttccgccgtggcgctgacgattatgcttatgctggcatctggcgtgctggcaaccgtgctgttaaagaagaaaagtctatagaaaatgaataagagccgtaccgtatcgggattgatgcggtacggtttttcttatgcgtaattatattttgaagggatttacaatccaaaatgaaagtgttacgataaagaaaccagaaaacaaggtaatcgttgtacaggcagcgattaccttgttgggagaggatgcaatgtttggacgattacgtaaagcggcaagccagcgcttaggcaggctgcgccgcgattggaagagtgaattttatagcgaggttaaggatatagcagagcatccggtggtattaaggatgaaattatatccgcaccatggcagcacaaactgttatcagcattgtatgaatgtggcatattacaattaccagtggtgcaggttcctgcacctggatgcaagatcggcagccagggcagggatgatccatgatttgttcttgtatgactggcatacgcatgccaggaagacgggggatcgtttccatgggctgacccatccggaaaagtcttatcagaatgccaggaaattttttgacctcaaccacattgaacgggatatcattctgaatcatatgtggccggttacattttttaaggttccaaggacgaaagaaggctggattacgacgcttacagacaagtattgcggcgcctgcgagaccagccgtcgaaaataatgggatctaccgggaacctgccggaaatttccatggacaagtcccaccaaccgctaaaatatgcggattccatatgctatcataagcaaaaatatgcagatgaggtgagagtatatggaaagacaatttcccaaaaatgtaagacagataggaaacgtaagcgacgagcctaagatatatgtagaagactatgtggatacctatctgaaccagctgcgcgaaagagcagccgaagagccggtaggagtcatgcttaccggcgagatcctgatccaggaaggacaggctgtggtatatgcttccggcgctatacgaatgaaggaaattgaagtaaatggtacggaaatagtaataggggaagacacatttaaggaactggaggaagaacgcaagcagtattttccatccagtgatgcgattggatggtgcctgattgagaatggacatcctatggggcagaaccgccagatagcaaaaatacacgagaaatcatttgcaaagtcagataccatatttatatggaaggatgcggtagacaatgaagaagtctattatgcatacaaatatggcgaactaatgcagatgggcggacattacatatattatgaaaagaatcccaatatgcagaactatatgatcagcacacgtaaaaagattggcgttacacccagtgaagtggttgaggatcgagctgcaaaggattttcgtagtgtcgtaagagaacgcatggaagataaagaacagcgccagagttccaggcttgtgtacgttacaagcgcgcttctggtagtggtagttcttgcgatcggcatctcaaccgttaataattttactaagatggaggcagttcaaagctcgcttgaatcattgtcccagtcggccagcaagacggagagccagaccgggacggtgaatgaaggcgaggacggggctgtggaggcaaacgggactatcggagacggggaggcaaaagataaggaagcctccgggggaacggttccagatacttctaccgtccaggaacagttaagcgatgaagattattatgtagtgagaaaaggggatacgctggacagcatcagcgtaaaggtgtatggagatgcctctcatgtagaggcgctctgtaaaatgaatggattgtcagatggaaacctgatatacattggccaaaaattattgttaccatagctggaaaatatgatataatgagcccaaagtgcgtaaggatgccttaagcatctttgatttatgacacgaatgaaaaggaacaaaggggaaacagatgatacaccgaagaaataagaaccttcgcgttgtcagagaaccggaaaatccagcagacccgacagataagattattgagcagattatggatgaacttaacagtgaagatggttcgatgaatgatatggaggaacagattaaaaagcataaaatcaagttctggcgcaggattatactcagcacggtggctgtattggcggttgcggccggcatatatcttctggtcaatcttcagacttacagcaaggcccggactttggacacctatgcaagcggcggctcggcgaacaatagttatatgcagtttgcggatggcgtgcttaagtacagccgggatgggattgcctatctggatcagaagggcgaggaacagtggaatcatgcctatcagattcagaacccttttttggatgttaacgagaaatcggcggcaattgcagacaagggcggcaatgacatcattgtattccaggaagatggcctgaaaggagagatccatacgacgcttcctatagaaaagatcaatgtctcagagcaagggattgtgggcgccattctgaaaaatgacgcatcagccaaagttatgtgctatgatactgcaggaaatgttcttgtggagcacaagacgtccttaagcggaacggggtatccgctggatgtatcgctgtctgaggatggtgaggtcatgcaggtggtttatctttatactcaggaggggaaaattacctcaaaggtagcctactataattttggcgaaaagggagaggataagacggatcatcaggtcgctcttaccgagtatgaggatacggtcatggcatccgggttctttctcaataagtccacctccgtagcaatcggcgacaactgccttgccatatataaagggggcgaggtcccgaaagagtcttctaagattatgatcgacaaggagatcaagagcacattccataatagcaaatatatcggcatgatcctcaagaatgaaggcaaggaaggatatgagcttcggctttacaatgccggagggaagatggctatgtccgaagattttaccggcgactataagaatgtgaaaatctgtggaagccaggttattatgtatgatggaaagaaatgcggcatttttatgagaagcggcgtgcagagattttccggagagatggataacaatatattagaaatatttcctgtagctggagtaaataaatacattgtgatgaatgcaaacggaatggagaaggtccggcttgtaaagtaaggagaacttatgaattggttattaataacagtaggcgctatttttctgataagtattatcgtcggcatatgcaaaggcgcaatcaagatagcggtttctttggcaacaactatagtgacattgctcctggtattctttgcaacgccttatgttgctaaagcaatcgcaaaatatacgcctcttgatgacctgattaagagccaggtggtcagcacgatggcaaatgtggcaacctcccaggttacaggggaaggcggcgggctctccgagagcagcgtaagaaaggttctggaagcggcaggggtcacagaggacatgctgtctcaatacggcatttctatagaagatattgtgaacggcagcattagcagcgaggatcttgccaagtacggaatctcaagcaatgtgctggatggcttaagcgacgataaaaagggatcgattgaagatgcgatcaatgaggctgagataccacgggatgtacaggtcgctgcgattgagaaggctgatttgccggatgtattcaagaacctgctttcggtaaataataatagcgagatatataaggaactgggggtagatacctttgcccaatatgtgggaagctatctggccaggctcattatcaatatcgtggcctttctatgtacgttcgtattaataacaatagtccttcgggcgatcgtgtttgctctggacatcgtatccaatcttccggtgctgggatttataaaccgtctggccggaggagcgataggggtgataggagcgctggtcatcgtctggaccgtatttgtggttattacgcttctgtatacgacatcctttggaaaggaaatgtatcggatgattcaatcggatgcaattttgaagacgatctatgagtataatcctattatgaaactggctacaatttttaggtaaaaaagttggacaaacctcttgacactgaaaatgaaagatgctattatataattccaccgctgagacgtggtggatttttaagcggtcaaggccagatggctgaaaagtgccgctgaaaaaaataaaaaaagatatcaaaaaagtgttgacaaaatatggaagcatgtgatatcatttagaagttgtcgcttgagacaacaacctacagaaccttgataattgaacaatagacaacaaccctgaaaatttcttgtaaagagagaatttcagaacagaacgggacatcgagagatgtccgaccttaaaacagtaataacgggaaagaattagccaagagttgattctgaccgcgatcacaacttttaacgagagtttgatcctggctcaggatgaacgctggcggcgtgcctaacacatgcaagtcgaacgaagcgcttccgcctgattttcttcggagatgaaggcggctgcgactgagtggcggacgggtgagtaacgcgtgggcaacctgccttgcactgggggataacagccagaaatggctgctaataccgcataagaccgaagcgccgcatggcgctgcggccaaagccccggcggtgcaagatgggcccgcgtctgattaggtagttggcggggtaacggcccaccaagccgacgatcagtagccgacctgagagggtgaccggccacattgggactgagacacggcccagactcctacgggaggcagcagtggggaatattgcacaatgggggaaaccctgatgcagcgacgccgcgtgaaggatgaagtatttcggtatgtaaacttctatcagcagggaagaagatgacggtacctgactaagaagccccggctaactacgtgccagcagccgcggtaatacgtagggggcaagcgttatccggatttactgggtgtaaagggagcgtagacggcgatgcaagccagatgtgaaagcccggggctcaaccccgggactgcatttggaactgcgtggctggagtgtcggagaggcaggcggaattcctagtgtagcggtgaaatgcgtagatattaggaggaacaccagtggcgaaggcggcctgctggacgatgactgacgttgaggctcgaaagcgtggggagcaaacaggattagataccctggtagtccacgccgtaaacgatgactactaggtgtcgggtggcaaggccattcggtgccgcagcaaacgcaataagtagtccacctggggagtacgttcgcaagaatgaaactcaaaggaattgacggggacccgcacaagcggtggagcatgtggtttaattcgaagcaacgcgaagaaccttacctgatcttgacatcccgatgccaaagcgcgtaacgcgctctttcttcggaacatcggtgacaggtggtgcatggttgtcgtcagctcgtgtcgtgagatgttgggttaagtcccgcaacgagcgcaacccctatcttcagtagccagcattccggatgggcactctggagagactgccagggacaacttggaggaaggtggggatgacgtcaaatcatcatgccccttatgaccagggctacacacgtgctacaatggcgtaaacaaagggaggcgaacccgcgagggtgggcaaatcccaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagtcagtaacgcccgaagccggtgacccaacccgcaagggagggagccgtcgaaggtgggaccgataactggggtgaagtcgtaacaaggtagccgtatcggaaggtgcggctggatcacctcctttctaaggaaaaagaagaagtaagggctgctgtctattgttcagttatcgaggaatgctggaagaggcatagggcgccgtaagaaggcccgatgcgattttctggcggcgatacgcccaggggcaacacccgttcccatcccgaacacgatggttaagccctgggaggccgatggtactttactggagacggtacgggagagcaggtggctgccaggatttaaaaaaagagaagggcagatgcagatccgctgcagatgttcgggatcagatagataccggcagggacgggcaacaacccgcagggccgaccccatcagcagggcagtgctgttaagatagctggtcttaccagtgattagaggtcagaagcgcattctggtttctaatggctgataaagcgtcagccgcgcatatgtaccttgaaaaccgcatacatggaaatacaagaatgatcaagaagaatatctagatcaagacatccgaggtaatcgcggaagcgattattcaaaacaaaccagattcgaggcaacgaatagaaaaaatgccgactggccaacgccggcaacgctatgccgacgtaggacgcaaggcgccgcccgtgcgccgctgtccgcttggtcatgctagaaagagcatatggtggatgccttggcactaagagccgacgaaagacgcgataagctgcgaaaagcttcggggaggggcaaataccctttgatccggaggtgtctgaatggggaaacccgcatgagaagccctcatgcatccctgcgccaatccataacgcagggaggggaacccggcgaactgaaacatctaagtagccggaggaagagaaaacaacaagtgattccgtaagtagcggcgagcgaacacggaagagcccaaaccggggcgcgtgcgccccggggttcggaccgcataattgatccgcgagaggtagcagaacggctttgggaaagccggccagagagggtgaaagccccgtaagcgaaaccgggagcggcaaggcgggatccagagtaccacgagacacgagaaaccttgtgggaagacgcggggaccaccccgcaaggctaaatactccttagtgaccgatagcgcatagtactgtgaaggaacggtgaaaagaaccccgggaggggagtgaaagagaacctgaaaccatatgtttacaagctgtggaaccgctttataggcggaaccgcgtactttttgtagaacggtccggcgagttacgccggctggcaaggttaagggctttaggcccggagccgaagggaaaccgagtctgaatagggcgaatgagtcagccggagtagacccgaaaccgggtgatctatccatgtccaggttgaagttgccgtaaaaggcaatggaggaccgaacccacatccgttgaaaagggtggggatgaggtgtggataggggagaaattccaatcgaacccggagatagctggttctcctcgaaatagctttagggctagcctcatacgagtcttgcggaggtagagcactgaatttcctagggggcgtcaaagcttaccgaagaatatcaaactccgaatgccgcgtagatgatgtatgggagtcagactgcacgagataagttgggcagtcgaaagggaaagagcccagacctgcggctaaggccccaaaatgtgtgttaagtggaaaaggatgtgggatttcgaagacaactaggatgttggctcagaagcagccatgcattcaaagagtgcgtaatagctcactagtcgagaggtcccgcgccgaaaatgtccggggctgaaacacactgccgaagcccagggatgtacgcagtacatcggtagaggagcattggatgcgggaggaagcggcaccggaaggagccgtggaccgcatcgaagagagaatgccggaatgagtagcgagaggaaggtgggaatccttccggccgaatatccaaggtttccagagtaaagctgatctgctctgggtaagtcggggcctaaggcgagggcgggagccgtagccgatggacaacaggttgagattcctgtaccgcgatatgacagaactgtggggacacgcgtggaaagcataagccgggaatggaaagaccggcgcaagcggggtaggggctgcataggcaaatccgtgcagcgcaacccgaagccgcgacgcgaaccgaactacgagtagggaagtatgcgagccatgcgtcaagaaaagccgctatcgctcatatcgcgcccgtaccgcaaaccgacacaggtagatgaggagagaatcctaaggccgacgggagaagcattgtcaaggaactcggcaaaatgactccgtaacttcgggagaaggagtgccatagagatatggccgcagagaattggcccaagcaactgtttagcaaaaacacaggtctatgcgaagccgcaaggcgaggtatatgggctgacgcctgcccggtgctggaaggttaaggggagaggttaggagcgatccgaagccttgaacttaagccccagtaaacggcggccgtaactataacggtcctaaggtagcgaaattccttgtcgggtaagttccgacccgcacgaaaggcgtaatgatttgggcactgtctcgacaatgcacccggtgaaattgaagtaccagtgaagatgctggttacccgcgccaggacggaaagaccccatggagctttactccagcttgatactgggatccggtattgcatgtacaggataggtgggaggctaggaagcgatgacgccagtcgtcgcggagccgctgttgggataccacccttgcagtgctgggtttctaaccagcagccgtgaaccggctgggggacaatgtcaggcggggagtttgactggggcggtcgcctccgaaagggtatcggaggcgctcaaaggtcctctcagaatggtcggaaaccattcgcagagcgcaaaggcagaagagggcttgactgcgacaccgacgggtggagcaggtacgaaagtaggacttagtgatccggtggtataaagtgggattgccatcgctcaacggataaaagctaccctggggataacaggcttatcactcccaagagttcacatcgacggagtggtttggcacctcgatgtcggctcatcgcatcctggggctgaagtaggtcccaagggttgggctgttcgcccattaaagcggtacgcgagctgggttcagaacgtcgtgagacagttcggtccctatccggcgcgggcgcaggatatttgagaggagctgtccttagtacgagaggaccgggatggactggccgctggtggatctgttgcgcctccaggcgcatggcagagtagccaagccgggacgggataaacgctgaaggcatctaagcgtgaagcccccctcgagatgagatatccctggcgacaagccagtaagaccccttgaagacgacgaggtggataggatagaggtggaagtgcagcaatgcatggagctgactattactaatcggtcgagggcatgaccagagaggccggaaggcagacggaggcccgggtctggggcgtttggatggaagtatttcccgtatgcggttttgaaggtatatatagggcaccaggaggccatactagcatgtatggaggccggtgtttttcttcaattaaagatagcatagtcctcgatagctcagtggtagagcattcggctgttaaccgaagggtcgttggttcgagcccaactcggggagttctggaaacatttcatagacgtaagtttatggaatgtttttatttatttaaaaatcaacgaacctacgtagacggaatatgggacaataattcataatgaaaggagattaaacaaaaataaacagaagaaatagggaaaaccaaatggtagcattctggtaatggcggtattcttgcctgctataattaactcagttttaggaaaaggagatagtagcatggcaagaccagcatttacagaagcgcagatcatacagaagacgttggagaatgtccgtagtttttacaatcgcaagcaggagatagcagtacttccaacggccgatgattttgtctggatcggggcgtatgattcccagtggagtgaaggccgggaccagtttgttgaactggctggtatagagcatgaagagtttccaatcctgttgtcagatgaagaatatcatcttctctttcatgagaggaatgtatgggttgtatatggacgttataaagtcactgcgacaaaggaggatgggagcgtatttcatgtgcatgtccggggtacctatgtgtggcgtatggtaaatggcgaactgaaattggcccatgtccatgattctcatggcgatatgccaataggccaacgggctttcgaagaaaggcagtatctggccgatgcggatttcctggaatatatgaagcacatggatatgcaaaaggcgaatcaagagaagattgtatttcgggataaggagaagaattaccattatctatttccttccgatattctttatctgaaggcagcggcgcagtattctattgtgcatacgaagtcggatcgttttaagacttgggggctgctggctgattttgagaaaaaagtgccggagacattcagacgtattcataagagttatcttgtgaatacgatgtatattgacagcgtcagacgctatcgggcgtccttaacggatgggcaggaactgcctattgggaaagaacgctatatggaactgaagaagcatcttcagaatggaatataaagcagaggattcgtggcctttcctgtaaaggccgcggatccttttattctttacatatgttttatagtaagtgtaaaggtgttgactttttatgccgaaggaatataatgaaccttaggaaacggtgaagccgtttttattttcggaatttatggaacgggttccacatcctgttatcagaattatagttggaggttacatatgtcaaaggaattaatgcagatgaatattcaaagggcgcaattaagaatcaaagcggagaaggaagaagtcgccaagggcagcatgcgccagcgctatcattttatgccgcaagccggctggatgaacgatccgaatgggctgctatattataaagggaaataccatttcttttttcagcacaatccatatagcagtttctgggattgcatgcattggggccacgcgatcagcgacgatatgcttcattgggagtatctgccggaggcgctggctccaagcgaggcatatgacagccatatgaagggcggatgcttttccggaagcgcgatagagcatgaaggcaggctgtacttaatctatacaggcgctacgaatgtgggaaacgggatggaacagacgcagtgcatcgcttatagcgaagatggaatccattttgagaaatatgatggaaatccggtgattgaagcgccggaaggcgtgcctgcctgttttttccgggatccaaaggtatggaagcacgaagatttattttatatggtatgcggagccagccgggggggaagaggacaggctctgctgtacagatcaaaagacctgcttcattgggaatatgtaaatgtattagcggaaagccggggagagtggggatatatgtgggaatgtccggatttctatttccttggggacaagtatgtcctgacattttctcccatgggagccggtgatagaaaaagcgtatatctgaccggggattttgactattccaccgggaaattctgctaccagacatcgggggagattgactggggacatgattactatgcgccgcagtcatttcttgcgccggatggacgccggctgatcgtaggatgggccaatgaatgggaatggatgtcctattggaaagactgggggccaacctacaaggaagggtggtgcggctctttcaatattccaagggaggtcaggcttatggaagatggcacgcttcagttccgtccgatcgaagaaatcagatccatcagggaggatgcttacagggaggatgccttgcttctggagccgggaaaggaatatgaccttaaagcgggcgacggagtggcatatgaactaaagatgaagatagatcttgaacatacggacgcttcccggatagagttgatgctaagaggtgacgggcagaggaggaccagatgcgtcatagaccttaagaaagcccagataagcgtggacagaagcctggcggacggctggagcaaaggggtatccagaagtcctttattcctgaagaataagaagaaactggatgtccatatcctgtcagaccagagttccttggaactatttacggatgactatcgaaataatcattccatgaacgtgtttgcgggaaatgaacaggatagaatgtacatatgcgccgtagatggtcaggcgcggatcgaggatatagaatcctatggcttgaaaagaacaatgtagttaacgggaaagaaaagagggaagaagcatggcaagtatcagagatgtggcgaaaaaagcaaatgtaggaccggctaccgtatccagggtcctgaataacagcggctatgtatcggaagagtcacggcgcaggatagagcaggcgatgatggaactggactatacgccgaatgaactggccaggaatctgtttcgaaagaagacggggatcgtagcgttactggtccccagcatctcccatccgttttttgccgcgtttgtggaaaaagccgaggaagctctccatagtcgaggatacaagacgatgctctgcaatacggcaaaagaggaaaatgcagaactggaatatctggatatgctgaaccgccatatcgtagacgggattatcagcggcgtccattcgctggagatcgaagaatatcagaagattaagaagccgatcgttgcattggaccggtatcttggggcggatatccctgttgtggcggtgaaccatgaaaagggcggccggatggcggcagaagaactggcgggcagcgggtgcaggatggtgctgcactttagaggcgatcaggcggtagaatccccttatcatgaccgccatcatgcatttgaccgtatcatgaaagaaagacaggtggaagtgtattcttatgaattggaacgaaaccgttttgacatggagtattttgaggcagtcatccaggacatattttccagagagataaagtttgacggcgtatttggcacggatatgctggcggctttatacttaatggaggcaaaaggaaggggccttcgtgttccggaggacgttcgggttgtatcctatgatggaacctatgtgtccaggatgacacgacccgggatgacggcaatcatacagccagtagaaaaactggccaatgaggcggcgaaaatgattgaccttctgattaacggcgaagcctgccatgaagataaggtggtgctggaagtaggatttcagcaagggggaactacgttctgaaacaggtgacatggattcatttatgaaagcatctacttattgggattatcaataaatgtcataatataacaaaaaaagcaataagacacataagccgggaaatgatagacttaaaccacacgggataaaaccaaaaagaggtgatggcttatgaattatattgggattgacatcggctctactgcttccaaggtcgtagtacggggaagcaaagaggcgtattttgtgctgcccacaggctggagcagcaaggagacggcccagactatccgggccaggctcagagagatggagattaatgtggaggatgaggcaaccaaggtggttgccacaggatatggcagaatcgtagtagactatgccgaccggacgatcacagagattacctgtcatgggcggggcggccgggaactggcaggcgaaaattgtatgatcattgacgtgggaggccaggatacaaaggtgatctctctaagagatggcatggtatatgactttctgatgaatgataaatgttccgcaggaaccggaaagttcctggagatcatggcgaaccggctgggggttacgctggaggaactatttgacatggcagggcagggaacggcaattccgatcagttctctgtgtacggtatttgcggagacggagattatcagctacattggagaaggccgtgaacgcagagacattgccgccggagtggtagaatctgtggcggagaaggtagcgcagcttgcaaagcgccaatccctacaggataagatcatccttacgggagggttgagcaacagcccatattttgcgggacgcctgtctgagaaacttgggaagacggtggagacaagggaaatgggaaaatacgcgggcgcattgggcgcagcgtatcttgcggaagaaaaaggttaacaggaggaagagaagatggaacttattaaggaattgccagaggtatttgaagagtttgcagaacaaagacaaaaatcgttcctgggcattaagaagctaaaggaacagggagtgccgatcgtaggcgtatactgtacctatttccctcaagagatcgcagttgctatgggcgcggcagtggtaggattatgctccacatccgatgagacgatcccggcagcggaagaagaccttccgaagaacttatgtcctttgatcaaatccagctacggatttgccaagacggataaatgcccgttcttttatttttccgatgtagtggttggagagacgacctgcgacggaaagaaaaagatgtatgagtatatgtctgaattcaagccggtttatcttatggaacttccaaaccgtcagacggaggaaggcctgattctgtggaaaaaggagattatccggtttaaagaatatttggaagaaaaatttgaaatagagatcacggaagagaagatacgagaggctgcgcataccatgaacgaggtaaggaattctatgaaacgactgtccgcgcttatggcatatgacccggctccggctaccggactggatatgttccatgtcatgtatggaagtaccttcaaatttgataagtctgtaattccatcagaagtagacgcgctcacaaaacagctggaggatgaatacgcgcagggcaagcatcttgacaagcggccgcgcatccttgtgaccggctgccctatcggcggcgcgacggagaaagtcatcaaggccatcgaggataacggaggcgttgtcgttgcttttgagaactgcgtaggcgcgaagaatcacgaccagctggtggatgaagataatccggatatctacgatgccctggcccgcagatatatggacatcggatgctcagtcatgacgccgaatcccaacaggattgacttaatgggaaggctgatcgacgaattccatgtggacggcgtggtagaagtgatcttgcaggcctgccatacatacaatattgagaccaagggtatccgcaagttcgtaaatgaaaagggcaagccctacatcagcgtggagacggactattctatggcagactgcggacagctgaatacaagaatggcagcgtttgtggaaatgctgtagaaatccattccggcaattataaaaattcgcactaaccggtcaattgataaggaagaatcgattgaccggtttttctgcttaaactgtggagaaaagtttgcaaatacttcgtatgtttgcttgaatagcaaagaggggtatgctaatatttaccatatcagacattctgatttctaaaattaatcaatggcagttcgccgacaaatccaatgttcagatcaaatttaaaaatgacgggagggatggcctatgggggaagtttcttgttttgtgtctgttaagtaactgatggttgtgataaaataaaaggagaaacatatgagtaaacaacagaatatgataccattgcaagaattaaaccttaccagccgttttttatttgaagaggtattggaagatcccaggacccatcaggatatattagagattatcttccaaaaagaaatccctctgcttgaaaagaatgagaccgaaaaagaattaagagtgtctccgctgcttcgctccatccgaatggatgtattttccatggatcaggaaaaggttatttataatacggaaatgcagcagaaaagaagggcagatttggcgaagcgcagcagatactaccagtccatgacggatacatcattgctggagccaggagtaccggattacaatcggctgaatacgtcgtatattataatgataatgccgtttgatttattcggttataaaaggtatgtatatacatttcgatccaggtgcgaggaggaggcagagtgcattcttgaagatggggcaacccgaatattcttgaatacccggggagagaatgatagcgaggttccccgggaactggtagagttcctgcactatctggaaaatacgacggatgaggcagctgccggggcggacagcgagaggatcaaaaggatccataaacgggtatgcgaggtaaggcatagcgaggaagtcggggtgaagtatatgcaggcatgggaagagaaatattatgagaaagaggaggccagggaagaaggcatcaagattggaattgaggaaggcattcaaacaggcgagagaagaaaattgagggaattggctataaagaagcagcaaaagggaaaatctatagaggagattgcggaaatcctggaagaggatgaagagacgattcggcagttgctggaagagcaggcctgattatatcgtaaacgcaatattaattttagtaagagaagagatacatgaacaaagcaggcaagagatatgcctgcttttatattgcttgaaaacgtaagattagacaaatagaagggtctgtctacataaaaaacatttacgcatgtttgttcctttatcttttgcggatatgtgcctagaatgttaattaaataacaaaactttagcagaaaggagaacaaaaaggaatgaaagattatctaggttttaaaggaaaggtatgcgttgtatctggagcaagaacaggtgtaggaaaagcggctgcggaaattcttgttgatcttggagcgaaggtatacgcggcaggcagaaacaggggggagattgaggggattgagaaatttgtcattatggacttatgcagtaaagagtcaattgacaaagcgtttaaagaattcccggaaaagattgactgttttatcggctgcgctggattatttggggatgtaaatgattttatgtctgtaactatcacgaattttgtctcgaataaatacataatccaggaatatttaagtaagcgtattgtcgacaaaggtacgattggttttgtaacatctaataacgggacgcactgggagcaggaaagatttagaaaagagtgtcaggcaaccattgaggcagagggctgggaaggaacgatacagcagcttatcgattccggattaagccagaaaacagggatggatgggtataatttttctaaaaggtgcatgaacaatttcctgaccaggactgcccatgatctaagcaagcgtaatgtcagggtcaattatgtcctgcctggccccattgataccaaaatgcttcatgcgtgtatggataatgcgggagcgccagtggaaagcctgctggattcagtgctggaaaacgctgaccatatctgcgcgccagaggaggttgcggctccattgatcgctatgtgctcaaatatgatgacctatgtaacaggggcggggatatatacggattttggcctggattcctatatccggcttggacttatagaagaccgggttgccggacaatatgaaccgttgatataagaaatcaaaggaggagtaggaaagatgacgaataagacaagagcttggcttacatggcttggcctggcgatagtagggagtttaatgggggttgcatatggcgctcctacgttgctgtatgagactatactggaaaataccgggtgcacgccgacgcagtttggatttattttttcagcaatgggaattggcttattgataggcagcctgttagtggggaaagcgattgagataaatagcaaagcgttttctatggcaggctcgctttgcgcattaattctttatgcggcaattgggctaagcaatagtatttttgtaattattgttgcgggatttttgtatggattaatcttccagttttgcggaaattcattgctgagtgccatgtgcgcgagatggttcaatataggcagggggaaagtcgtatctattgcatttgtattgcaggcattagcgagcgttatactgaatcctattttggcaaaactggtagtagcgataggaggaaaggcagcggccctgctattaggaattgtattttcgggagtatcctttttcctcctggcatttgcggtgagcagattcccggaacattataatatgaaagcgattgatctcgggaaaaatatgaaggaagaaaagatatcagaagaaaaagaagcagaaggatacgagtgttctttgccagtgttaaaaatcattatgacacccgcgtttttactgcttgcggtcagtgtattccttatgtctatgggctcaaatatttattttagcaattcaaccatgatcttccaaagttttggactggattatgaaagcgctgctctggcaatgtccatatatggaatcgcgggcatggccattagttttttgagcggcgtgatcattgataagcttgggccgaagaaagggttatcaatattttttgggcttgcggcagcagtctgccttgcgtgtccgttattaaagggttggacaggcgctgtgatttttgctgtatttatcccctgctgctcggtttggaatatgattgccgctatggcgctgccaaagatgtttggcgtaaaaagaagcgcttcgcttatgggctatattaatttctgcggaagcctgtgctcgatcattatcggaccgatagccaccggactttatgggatgacaggctcatatgtaacgcctgtcgttattaccggagcaggcatagcgattgctacagtatttgtatggatttccttaggagataagatggctgcaggcgtgcgcaggcgggatgagatgtttcagattaggaagaacgctaattaagcggcattgaatattttttgatttctagatggccgggatgtcaagtatttcaactagattaaagcggaatttatggtataatgaacacaatgagccaggcgggaagcgtttggcgaatgtgtgataatcactaatattctatatgaggtgtgcatatggctttaaaagttgataccaggagaatactggctgagtcattggaaaatttattagagaagagggaattgaaggatataacggttaatgagatcgtagggaactgcggggccgcaagaagtacgttttatcatcattttaaagataaatacgatcttgcgaactggatatacgaggatttcctgaccggatatctgaatacgcaggagcacgtggatatggattactattccatgcaattggagccattagaattcatctattcaaagaaaactttcttttcgaagatctgtaaatataagggccagaactgcttttatgaatttgtgtttcagatcacgcaaaaaagagcggttgaaatggccaggagaattcaaaaaacggataatctcccggaggaaatcctgatagcaatagattatatgtcatcggggcatgcctatctgctcaacaaatgggtggtgcagggattttttatcaagccggataagatggcgcagtatctgctagagaatacggcgcctggtattgaacgcatctgcagggtggaagagttataatagggaaagcgtttaaacccctgaagcattggagttcctttgcttcaggggttttgtattgattgatagtgttaaaaataaaacaaaataatccaagtgttgtttggatggacattcaggggtgtttgttcattgtatttggagggcagcgaggttataactgaatcatagataatacatagaacaaatcaaatgtcagaaaggatgaaaggaaatggagtttaaatcaatttttaccccgttgaaaatcgggaacatggtacttaagaatcgcctggttatacctggaatgggaaacaatcttggctcagaagacggggctggagatatgacgccaaaggcacaggcatattatgcagaaagagcaaagggcgggtatgggctcatcatgacagaggttgtccgtgtaacagaggacggcaattccataccacaggaaattagtatttatgacgataagttcattcctggcttaagaaagatggtggaagaagtacatcaatatggcagtaaaatctgcgcgcagcttcatcacgctggacgtgaagcagaaagaagccagaaagcaccttccccgattaagatgtcttcttcgccattcttcaaatctgtggcacctaaggaactgacaacacaagaatgctgggaactgatacatgcattcagcgatgccgccgtacgcgctaagaaagccggatttgactgcgtagagcttcatggtggccatcagtatctgatcgcacagtttctctcgccttatacaaataagagaacagacgaatttggcggaaatacggataaccgggctcgattccttacagagatcatcaaggagatcaaagaaaaatgtggagattacccggtgatcgtacgtatcagcggagatgaacgggcatacggagggcgcacgccgcttcagagcgcggtacttgcaagaattattgaggcagcaggcgccgatgcccttaatatcagcgtagggaatggagcaaccaatgcaacggtggcaccgccttcctaccccatgggccatattcttgatgatgcctcaagagtaaagaaggcagtatcaataccagtaattggagtaggacgtgtccatgatccctatatgattgacgcggcaattgacgaaggatgggtagatgccgtggcagtaggccgccagtctatcgctgatccatacttcccgaataaacttctggccgggcatccggaagaggtatgcccctgcgtatcctgccttcagggctgcgtgggcagattaaatgatccagattaccttgacattaactgcctgatgaacccatttgtatcccgggagcatgaatggaagatcgaagaagcaggacaaaagaaaaaaatcgtcgttatcggcgcgggggcggcaggtatgcagtatgcccagattgcggcgcagaggggacatgaagttattatttttgaaaagaatgatcgtgttggaggacaggttcttctggcggctatgccaccgtctaagcaggcattttgctcggcaatccgttactgggaaacgatgtgtcgaaagtacgatgttgagatcagattaaatacgactgcgacagtagaattaataaatgcggagaatcctgatgtcgtggtcatcgcaaccggatctttgtctgcccatcctccgttcaaggggcttgaagaacatgcggttatggatgcaagagaggttcttataggcaaagtcactccagaacataagtcaatggttatcggcggcggcctagtaggatgcgagctggcatccatgctggcagaacagggacatgagattacgatcgtggaaatgggagaccatctgctgccggaacttgcgctgtggcagcaatgggcacagcaggatctgctggagtttgtaaccgaaaagtgcaagatccagactagttctaaggtgatggaagtattaaaggatggtgtcgtcttagaatgcaatggagaacaactgactctggacggctatggcagcgtgatacttgcgtgtggcgcaaagccgctgaatgtattctctgataagctgggggatattcctgaagtccaggtcatcggggatgctgtgaaagtgagcaagatcattgatgcggttgaagaagcgacgagatatgcgctctatgtataaatagtataagttatggcaattaaggaagggggtgcgtcagccccctcctttttttgttaggacagttggaatgcgagacatttcagctgttttgtttatccagtatacagagttaatgatttgtatatatatttctgccccaggccatgtgataattttaacaaaatattgagggataaccatgtggaaaggagaagaaagtcttgaaatcaaaaatatattatggatattttgtgacgttcctggcaggcttgacaattatgggatcttatggaatcttgtcgtcttgtatggggaattttattgccgcgggcattctgaagaaagggtggaatgcagcaattgtaggcctggcatattctatgcggcttattccttctgcaatatctccgctcgtaggcattatactggccaggtttggcccccggcggactattttttggacaacattattaacttctataattgttattatatgcggatactttgattcagcatggggattcgtatttggatttggcctggctgttggcgtatcaatgtattttaatgataatcttgcctgtactacagtaatcaataattggtgggaaaacagaagaggccagatgagcagtatgttaatgacgttttcatatgcaggaggagttatctttcctcttataatcgcctggatgttaaggacttttgagtggaagaccacaatgtggctttgcgggcttcttcttttctgtataacagcccttccgcagtttttctggatgaaagatcgcccggcagaaatgggattaaaaattgaagaaggcctgaagccaaagcaattgaagaaaaagaagcggataacgaatgagccggcggacgagccggaagattgggatgtgaaatcggctcttaagactccgcagatatggattcttggaattttgtatggattcatctgtacgccatttattgtagttatgaattattccatcactcatcttgaaatgaatgggatgggaggaatgcaggccacttattttatatcgggcctgagtgttacgacgtttattttcacgctgtttatcgggaccattgttgactatcttggggtaaagaaaagttttatactcgcgtttttaatgggggcggttggaattataagcatagtatttgtaaactgcagttatcttacctggattatccctttgatatgctgtccatttccgatgagtatggggctgcctatcgtgactactgctgttggcgattattatggcaaaaagaatttttcgataatatggggatttgcgctgccgcttactacgcttgcaacgattggaatatcaccattagtaggcattatgctggctcattttaattcgttgacgctggcgtttgtggcagcttcgcttcatcagctagtaggaattgtcctcgtgctttttctgaagaagccggttgggcaacgctgccaataagtaaattaagacattctcccaagggacgttttcctgcatggcgggttgacacaagtccgattccgtactataatacgtctgttgtgagtacggaatcggactaaggagaggcttatggaaaatacgtttggaaatgaattgagagagtttaactgcctttataaagaagtggatgagatatatcatgagatagccttgaagatgggaatatcggacagcggatttattatactgtacgctttggcggaactgggagacgggtgcctgcaaaaagatattgcgaagatttattatatcagcaagcagacggtcaattcttccatcagcaatcttaagaagaatgggtatgtatgcctccgtccgggaaaaggccgcgatatgcatatctgcctgacgcctcgaggcgaggaactgatccgggaaaagattgttccggtaatagaagcggaaaacagtacatttgccgctatgacccaaaaagaaagcagggaactgatcaggctgaccaggaagtatgcttctcttttacgggaaaaagcggaacaaatattatgatttagggggactcatgagaatacagctatcagatcactttacttatagaaaacttattaggttcgtgctgccatctgttgtcatgatggtctgcacatccttatacagcatcgtagacgggctctttgtatccaactttgtagggaagactccatttgcggcgattaatctgaccatgcctcttctgatggggctgggctccattggattcatgatcggaacaggaggcagcgccatagtttccaagacattaggagaaggaaaggaagacagagccagccaatattttacccttcttgttgctgccgcggcagtattaagcctggtattcgggattacaggctttatctttgcgcgcccgatcatggccgccatgggagccaggggcgagatgctggaatattgcgtgatatacgcgagaatctcgctgtgctcgatgccggcgttcttcctgcagaatgtatttcagaacttcctggtggttgccgaaaggccagaattaagcctgaaagtatctataatggcgggacttacgaatgtggtgctggactttgtatttattgtaatcttcaagtggggaatcgtaggagcggcggttgccacggccatgggggaagtggttggaggagtcgcgcctatcctgtattttgcggggaagggaaacaggctgatccgatttacgaaaaccaggctttatggaaatgtgattctcaaggcttgcgccaatggctcgtcagaactgatgaccaacgtctctatgtccctggtaaatatgctgtataatttccggctgatggcagtagcgggagaaaacgggatcgcggcctatggcgtcatcatgtatgtgaattttgtgttttcttccatgtatattggctattctatcggtgcggcacccatcgtttcatatcattatggggctggaaaccggacggaattaaagaatctgctgaaaaagagcctggggcttatcggcttaacggggatcgtgctgactgctttggcggagattacttccggtccattggtggagatctttgtaggctatgatagggaattattcgagatgacttgccatggattccggatttatgccctgttctttatcatctgcggcttcaatatctggagttctgccttttttaccgcccttggaaatggagtggtatccgccactatctcatttctcaggacactggtattccagagcggcgcggttatgctcctgccaatattcctggggctggatggcgtctggctggcggtggtggcggcagaaatcatggcgctttgcgtgtcagccatcttctgtgtggcacagagaaagaaatacggatatctgtaacgtgcgaagagagggctgtcggttagtaccgattttagcccctgatatttaagaaagagagaaccctgtagaattcaggctttttcaaagccttgaccttccacagggttctctctttcttgacggacaggttttatgcgatctatgcgatagcgatgtcagatctgttcatagactttcgccaggatatccagaagctgttctctgtcgaaggcagcggtatccaggcagaggtcgtaattctccatatcttcccaatactgatccgtataatagttgtagtagtagctcctgtctttgtctaccttgcggatcagctgctccgccttcttctcatccagagaataacgctccatgactgtccggatacggtcgtcataaggcgcatacaagaagacgtggcggctcgtctggcagtctttaaggacatagtcagcgcagcggcctacgatgatgcagtcctccctttcggcaagttttaagatcacgtcagactgggtctcaaacagtttctcgtcaatgtgctcatatcgatatctgcggtccaggccggaatccagatcgacttgataagaccagggcttttcacgtttttcatctacacgctttaactgctcatagggaatatcgatctgttcggatgccagtttgatgagttccttgtcataacagttgatcccaagctttgctgccagagcgtttccgatgatgcgcccgtcacttccgaattgccgtccgatggtaattacacgtttactcatatatataccccgctttctattaggaaagtcctttgttagggtggactcctttactaatttcagtgtaacatgcccggaaaaatgtgtaaagaaagaagtggaaatgatattctgtccagcttttttggctgtttgaaaggaccccctaccggggttgtgacccccaaaatgcaatgatatacttggtgaaaaggatggttttggaggaggaaaatggtgaagaaaaggctgataagtattttaggaagcattgcgctggtggcgggccttcttgcaggctgcggcaaaagcggctctccagatggaggttctgtagagagggaggaagaccggctgatggatgaggttgtggtaaccatgcccgcaacgtcagagcctgaatctggatttgatccggcttatggctggggagcgggagaacacgtccatgagccgctgatccaaagcactcttactaagacgacagaagatcttaagattgaaaaggatctggcaacagactatcaggtaagccctgacggccttacctggacggtcacgatccgtgatgacgcggcgttcacggacggggagcctctgacggcggaggatgtggcatttacttataataattgcaaggataagagcacagtcaatgattttaccatgctggataaggctgtggcagtggatgataagactattgagttccatatgacaagagcattttctatctggccctatactatggcggtagtgggaatcgtcccggaacatgcctatgacgagaagtatggacagaatccgatgggttctggccgctatatcatgaagcagtgggataaaggacagcaggtgatctttgaggccaatccggactattatggggagaagccaagaattaagaaagttacggttctgttcatggaagaggacgctgcgctggcagcagcaatggctggaaaagtggatgtggcgcatactgcggcttcttacagcgagcagaacgtagaaggctacagtcttttggccgtgcagacggtagacaaccggggatttaacctgccgtgcggcaagccgcgggaaaaggagggcattacttacggcaactcgtttacggcagatgtgaatgtaaggcgggcgatcaatatcggaatagaccgggaagagatgattgaaaatgtgctgaatggatacggaacccaggcctatagcgtatgtgacaagatgccctggtataacagccagtgcgaggtggaatatgaccaggaggaagcaaaaaggcttctttcggaggccggatgggaagagggcaaagacggcatccgggaaaagaacggggaaagagcagcctttaccttgatgttcagcaccggggacagcgtccgccaggcgcttgcggaagatacggccaatcagctgagggaaatcgggattgaagtgaagaccgagggcgtaggctgggatgtggcgtacgacagggcccagtcagagccgctaatgtggggctggggcgcccatacgccgatggaactgtacaatatttatcatactcttgaaggaaaaggtattggacaggcggagtattcgccttacgctaatgaaaaggtagaccagtatatggatcaggcgcttgccacaggctcattggaagattcctatgaattatggcaaaaggcccagtgggatggaaacactggcattacccaggaaggggatatcccatggatctggctgtgcaatatagatcatctgtattttgtaagggacggcctagcgatcgcggatcagaagatccatcctcatgggcatggatggtctatagtaaataatgtggatcagtggttctgggaggacaaataatgaaaaggcgctatgccattaagatcactcaaaacatcatacgggcgctgcttttggtgatcctgaccagcatggtggcattcgcgcttatgaaggcctccccggtagacccgcttcaggcgaacgtcgggcaggccgcgctgggcagcatgagccaggagcagattgagaagctgcgtgaatattggggagtcgggacatcccctgtccggcagtacctgtcctgggccgccgatttcgctacaggcgatatggggacatcccttttgtatcgtcagccggtcaaggacgtgatcgcggtcaaactgtcgaattcccttttcctgatggcgcttgcctgggtgatctcggggatactgggatttgcgctgggagcggtcgccgggatgaatgagggacgtttgatagacaagggaatcaagggctattgccttttgatctccagcacgcccaccttctggctggcgcttcttctgctggtagtattcggagtatggctgaaaatactgcctattgggcttagcgtgccgatcggagtggaggccagcggggttacattcatggaccgggtgtatcacgcgattctgccagcggttactttgagcattaccggcgtatcaaatatcgcgcttcataccagggagaagatgatagatatcatggaaagcgactttatgctgtttgcgctagccagaggagagaggggctggaggcttttctggcgccatggattccgcaacgtcctgcttcccgcgattacgctgcactttgcggccatcagcgagattatcggaggctccgtccttgtagagcaggtgttctcctatccggggattgggcaggcggcggtagcggcagggcttggaagcgatatgccgcttttgatggcgattaccatcgtcaccgccctgttcgtctttggaggcaatctgatcgccaatctcctctatgggctggttgaccctagaatcagaagaggaggggaggcacaatgaagcatttgaaccgtagaaagagagtaatggcaggggtggcgctggcgacggccttccttcttgccgtatttatcggaggttctatctgctctgaactggcagtggcgacagactttactcagaagaaccttcctccgggagcgggacatctttttggcacggactggatgggacgggatatgctggcgcggacgttgaaaggactgtctttgagcatttttcttggaatcctggcagccggggccagcgcatgtattgccctgattctggggattgcttccgcgacacttggaaagactgtggataaggtcattacgtttatcattgatctgatacttggaatcccgcatatccttttgctgcttttgatctcagtggctctgggcaaagggcttagaggcgtggccctgggaatcgcgctgacgcactggccatcccttgcccgcctgatacgggcggaagtattacaacttaaagaaagtccgtacatacaggttgcgcagaaacttggaaagagcagatggtacattgcccgaaagcacatgctgccccatctgctgccccagttcctggtagggctggtgcttttatttccccatgcgatcctgcatgagtccagcatcaccttcctgggattcggcctgtctgcacagcagcccgcgatcggtatcgtgctgtcagaatctatgaagcatctggtgacgggaaaatggtggcttgccctgtatcccggaatattcctggtactgactgtagccatgttctatgtagcaggggaagggcttcgtaagatcgcagatccaggaagcgtgcacggataggagaagagaaaatggaattactgaatatcaaggatctgaatatatcgtttacgcagtatgataaggggatgcgccagaccgagctgaacgtgatccgcagcctggatgtgacggtgaacgccggggagatggtggcagtggtaggctccagcggttcagggaaaagtctgctggcccatgcgattctggggcttttgccttataatgcttccataaaaggcgatatggcctattgcggcagcgaactgacgcaagaaagaattgaaaaactcaggggaaacgagatcgtcatggttccccagagcattgcgtatctggatcctctgatgaaaataggtccacagatccgcaaagggagaaaagacggaactacgaaaaagaagttaagagacattttttccaggtatgagttgaaggaggatgtgcagaatctgtaccctttcgaactttccgggggaatgaaccggaggattctgatctcaaccgccctgattgaagaacccaggctggtgattgccgatgagccgacgccgggtctggacttaaaggtggcaaagagggccatggggcattttcgggaactggcggatatgggggctggtgtgctggtgatcacccacgatctggaactggcgcttgaagtggcagaccggattgtcgtcttctatgcgggatgcacggtggaagaagccaaagcctgtgatttcgagaaggaagagacgctgcgccatccttataccaaggcgctgtggagggccatgccaatgcatggattccagactattgaaggcacgcagccgtatgccaaggatatgcctgaggggtgtccgttttctcccagatgccagtcatatacaaaggagtgtgtgagggaagttccactgcgacatctaagggatgggcgcgtcagatgcctgcatgcgagatagtcgatctgccgcagggtgaaaaatcaggaggtccaaggcctggtggccgcaaggcaagtgagattaaagagataggagaggcaggaatatgagattagaggcacgcggggttgcttaccagtatggaaatggaagtccaaggattcttgaagactttgattttgaaatggaacacacggagagggtgggcattatggcacccagcggatatgggaagacaactctgtgcaaactgctttccggttatctgaagccggaaagaggccaggttcttctggatggaaggcctcttagccaggagaacggctactgcccggttcagatgatctggcagcagccggagatggctgtcaatccaaggatgcgtatgagagatgtgattctggaaggagaccaggttgaagaacgagtctggagggagctagggatcgaagaagactggatgaaccggtttcccacagagttatccggcggcgaattgcagcgattctgcatagccagggcgctggggaaaaggacaaggtttttactggcagatgagatcagtaccatgctggacttgatcactcagagccagatatgggacttcctggtcaaggaagtagggagaaggcagatcggactgatcgtagtcagccacaacaggccattgcttgatcatgtctgcacgagaattgcaaatttgagcaagactgcatataataagtaagtagggacaatattttgcccttatttacttattttattgtatacatataggcatagaaaaaggaaaagcggcttggggggaataatgtggacaggatagagagcgaacggcagacgagacagtacataaaaatgacggagacaccggtgccacggctcataacgcggcttggcatccccacgatcatcagcatgctgataacgaatatctataatacggtagatacatatttcgtgagcatggcagggaccagcgccagcggggctgtgggcatcgtgttcagcctgatggcgatccttcaggcatttggattcatgttcgggcacggtgcgggaagccttatctcccgcaagctggggaataaggatcaggaaagcgccagcaggttcgcgtccaccagtttctttatggccctgctgtttggaactttgattggagccctggggattctttttctgactccatttatgcgtctgcttggcagtacggagacgattctgccatatgccaggcagtatgggttcttcattctgcttgccgggccattcatgaccagcagctgcgtgctgaataatatcctgcgttatgaagggcgggcggcatatgccatggtagggctaactgccggaggaatcctgaatatgatcggggatccgatattgatgttctatctgaatatgggggttgcgggagccggactgtctacggctttgtcgcagataatcagcttcctcatcctgcttggcatgtttctggcgggaaagacggagagcaaactctccctccgcctggtgacgaggaaggcggaagaagtggccgcgattgtaaagaccggttttccgagcctgatccggcaagggcttggcagtatatcgacgatgctccttaatcatcaggcaggcgtctatggagatgcggcggttgcagccatgagcatcgtgaaccggatatgcatgctgatattctccgtagggcttggccttggccagggctatcagcctgtggcggcgtttaactacggagcgggaaaatatgaccgggtgaaaaaaggcttctggtttacagcggcatcgggcgagatcattctgggcggactcgcggcaattggactgcttgtgtccgctaatgtgatcgggctgtttcgggatgacccggaagtgatccgcattggcgtgacagcgctccggttccagtgtgtcgcctgcttcttccagccgcttacagtgtgtacgaatatgatgttccaaagcgtgggagagagcggaaaggcatctttcctggcatcgttaagaagcggcatctgcttcatcccgctgatattgatccttccgtcttttatggggcttgcaggcgtgcagattgcccagacggcggccgatcttatgacattcgcaatatcgctgccgcttttgataccatttttacgaacattggagaagacgaatgaaaaagaaagttgtgaaatatagtttgcttgccctgctgatcatactggcggcattctcccagacattaagtatgaaggccgatatcggcgtgtgcgcctgctgggattctgtcagcatgaatgtatatcagattaccggaataaaggtagggacattcagcatagtggggaatctggcctgcgtggcgatccagctgctgattctgaagaaagaatttccacctgtgaaattcttacagattccagtagccatccttttcggtattgtaacgaacgcagtatactatcatgtactggtttttgagatacacagctactttgtcaggatgctgttgtgggcgttatcctatataggtctcgcgctttttattggagcgctgacgatcatggatatcattaccatgcctgtagagggaacttgctatatcataagcagcaggtatggaattgattttgccaaactgcgcctgtcagcggatgcagcctgcattataatctctctggccctgacatttgcctttggcctgaccttgaagattcgcgaggggacgatagcgggaatgctggtgctggggccactgatgggatggtgtatgaaatgggagaagaaagtactggaacatattgacttatagtgtccgccgctttcctattctttgctggtatgttagaatattggcaggacatatcgcgaaggaaagacaagatggaaaggcatgttatgaagaagagactacatataacgaaccgaataaaaggaatcgccggctgcatattattggcagccggttttgcactgctttttatctccagattatcccaggagtttgcccactggtacagcacgaaggtgtatccggtctgggtgggaaccacaggcaggctgatgaacctttttcctttttccgtgtctgaagttcttctgtatatcatgattgtcattattctattgtctgcaggagtgctgattataaaagaagtgagaagaaaggcagggaagaaggaggcgtgttcctggggaatgggcgtgttcctgcttgcggcctctctgttctttctctatgtattaaactgcggggtcaactaccaccgggaatccttctcggaaagttcgggcatccaagtaaaagactatacggcgggcgatttaaaagaagtctgccagtggcttacccagaaggtaaatgagacaagcagccaggtggagcgcgatcaagacggagtgatggtactggatatcccgatggagaaatacgcagcagaggcaatgaggagcctggggaaggaatatccggaactggccggatattatcctcggcccaagggattgctggtgccttttatactctctatccagaatctgacaggggtctattcgccgtttaccgtagaagcgaattataacagcgggatgacagattacaatattccttttaccgcctgccacgaactttcccatctgagaggattcatgcaggaagaggaagccaatttcatcgcctatctggcctgtagcagatcagttaacgcccagttcagatacagcgggaatctgctgggatgggtctactgtatgagcgttttgcatacggtagattatgacgcgtgggaagaagtgcgtcagacgctggcgccggaagtggagccggatcttgcggcaaaccgggagtactgggccagatatgacggggcagtggcagaagtatctaacaaggtgaatgatacctatttgaaggcaaacggccaggatgacggggtgaaaagttatgaccgcatggtcgatctgatcgtcgcctattatttgcaagttattctggcgtagacattcagtctatgctagaatatgaataaagcattatatttctaatactctagcggcatatgctgtatcttcaatctattgcctaccggcatctattcggaaatctcaatgcttaaaaacccaggaaaacagcagagaggttccggaatgaatagggtgcgagaagggagcctcctgcaattaaacaaggaggaaaacctatttcagagaatccggaattagacaaagaggaaggaatcagtaggataaagaaggaggctgatagtatatgaatgtaggatcaaggctgacggttaaggcgtaccctgtcacagaattgtgctatggggaggagaatcgggtgacggtggatggcaggatgacggtctgcaagaatattgcagacaagattctggcgcaggaaccattgattaaggagattgatatccgtattatcatgccgaatgagcaccagcagcataccaacacggtgatggatgtgattcctctggcaacaaaagtgctgggacgggtgggggagggcattacccataccctgacaggcgtatatgtgctccttaccggcgtggatgagagcgggcgccaggtgtgcaattttggagccagcgacggaatactcgaggagaagattgcctgggggcgggcaggaacgccgcttaggagcgatatgctgatctcctttgacgtagtccttaaggaaggatcctgggcggaccgtccgggcccggaagcagcccatcgcgcctgcgatacattctgccagatattccgggatcaaatgaagaagttcaatggatacaagtgcgcagaaaagcatgtttttcaggagacgtatgagccggggaaaaaagatgtctatattgtaaaggaagtatccgggcaaggcgccgtatatgatacacggatgttcggacatgagccttgcggattcgaaggcgggaagtctgtcattgatatgggctgcatgcctgcgctggtgacgcccaatgaattcagggatggcattatgcgcgcgatggactaggattcgacaataaagtatggaggtgcagttatgggaattggaacaagcatgaaagaaacttccctgcattattacagggatcctttggtagaagccgtatcggaagacccggaagtcaatctgagggggatcatcattgtgggatcgccggataagaatgaggataaatatctgtcagcggagcgggtcggggtcagcctggaatgcatgagggcggacggagccattttctcctgcaatgggattggcaataatcacgttgattatgcccatgccattgaagcggcagaagtaagggatgtgccggtggtggctcttagcatgtgtccggcgaaggacttcgtggtgcagaatgatcatctggatggcgtgctgtcctactataagacgattgacaagatggggcaggccggggacgagacgacggtacttgccgagaatacggtaaataagctggatgccagaaaggcgctggcaatgctgaaattaaaaatgagaaagaaagaacagaggtaggaaaaatggagattgaaaagatgtcatgtattgactgtgcagtaaagaattgtgataaggaagataaggcgtttccagaattctgcgtgaccacgcatctgaaccaggaagtattgcaggatgcgttggagtgctatcgggaagaagagaatcatgcgacgatggtagcagcggcggaagtggaatacgagcattactgccagtacacaagagtacaggagatcatggcttttgctgaaaagattggggcgaagaagattggtatcgccacctgtgtcggcttgctctcagagagccgtactttagcaagaatattcaggaatcatggatttgaagtgtatggtgttgcctgcaaagtgggcgtcgtgccaaaggttgacatcggaataccagagaaatgtaccgggatcgggaagaacatgtgcaatccgattcttcaggccaagcttctcaatgagcagaagacggacttgaatgtagtggttggcctgtgcgtaggacatgacagcctgttctataaatattcggacgcgatcgtgactacagcggtgacaaaagacagagtgctggggcataacccggtggctgcgctttacacggcggatagttattacaaagagaaattaaataaataaaaactggacagaatagaagcagacagccttaaaaggtcagcttgacaggagaggatataagaatcagatggacagacagtatgatggcgcgctgtttttagcggacgtgacagaaaaaataaaaaccaggcttgaagaaatcgaccggtctcttgcagaaggccagcaggagattgaaaacatgcacgagtattactgggagaattatacggagatggaccagtatggctatgaggattacgataaccagcaggcgctgctgcatcaggtgaatgccaatcaggaaaaatggatgcagaagcacaggtatgagaagatgatcgcttccccattcttcgggagagtagactttatctgcgagggagagatggagccatactatatcggtatcggaaactttgcgccgcgtctggggatgaggcctatggtgtacgactggcgggccccggtcagcggcctgttctacgattatgacagcggcccggccttctacgaggccccggccggcctgatagaaggggagatccgtgctaagtggcagtacaagattaagaacgaaagactcatctatgcctttgagagcgatacgaagatcgatgatgagattctaaaggaagaactgggaaagaacggcgatgtcaggcttaaaaatatcgtgcgtaccatacagaaggagcagaacgccattatccgcaacaccaaggataagatcctggcaatccagggagcagcggggagcggcaagacgagcgtcgccctgcaccgcatcgcgtaccttctttaccatgaccgtaagaacctgaagtcttccaacatactgatcctgtcgcccaacagcgtctttgccgactatatttcccatattcttccggaactgggggaggagaacatccgggaaatgagttttgatctgtttgcctatcgggaactgaaggatacggcagcggactgcgaggacagataccatcagctggaacgcttgatgcgatgttcggatgccaggagcgcagaacgataccatgagaagcagtcggaggcattcatcgggcagacggagggcttccttgcttcgttggaagatgcacttctggattttaaagatgtggaattccgggaaatgaaattgaccgaggaggaattgatccgtctgttctacttcaagtttaaagagacgccgcttcttgcaaggatggatgcggtaatggagtatttcattgatgcatacgagaccttgcatggcaggtccctttctgatgaggagagggaacggcttcaaggtaagtttgatcagatgtatgtgacaaaggatatctatgagatctacaatatgcttatggaagaatgcgggtatccgaaacttcccaaggcctcttatgagaagcgcctgatcgagtatgaggatgtgtttcccatgctctatcttaagtacaggctgaagggaacgaaagcccataagcatatcaagcatctggtcatagatgagatgcaggattattcgtatcttcagtatgtcatccttcagaatctgttctcctgcaggatgacgattctgggagaccgggcgcagacgctggatgaaaagccccatgacgtgcttgccttcctgccccggatatttggaaagggaatccgtaagatcgtgatggataagagttaccgcaatacagtagaaattgcagactatgcagcacggatcagcggcatcgaaggaacggaacttctgaaccggcatgggaagccagtagaagaacagacatttttcaaagaggaagagatgctggatgcaatctgcgagaatctgaacttgggagagaatgaggaaaatagcgtcaacgctgcgaggagcagcgagggatacgagacggcagcggttcttacaatgacggaaggggaagccattgctatctatcggctccttaagaacagaggcattgaggcatcctatgttgaccgggatagcagtttatttaagaagggactgacggttacgaccttctatctcgcgaaaggactggagtttgaccaggtatttgagattcagggggacaaagagaatccacttcttgggcaggccgcctatatctgtgccaccagagcccttcatgaattatatgtatattgcctggaggggtaagaaaagcaggcacggaatgggagaggccattccgtgcctgaattatggatatgcatttgcaatctatgtgtcaatcttgatattcgccagcgcgtttgcaaaagcattattgattggttcttccttctgcttcttcagatagttctggacatcttttttggaaactccggcgccttctttttctcttcgcttcttgaaagcggagagtttttctttgtatccgcaggcgcagacaaaggtctcttcttcgccttttttgataatctccatcttcttgtggcagtttgggcagcgggcattgctcagccgggcgatggtctcccggtagccgcattcccggtcctggcataccaggaggcgcgcgttctttccgttgaccgccagcatccgcttgccgcatcttggacacttggtattggtcagattatcatggcggaaggtaccgtccgctgtcttgatctcctggataagttccttggtgtaatcctgtatctcggcaaggaactgggcgtctttgtgggcgcctttggcaatgttggaaagttccagttcccacttggccgtaagttccggcttctttaagtcctcgggaactagttccagaagctgctttcctttggaagtgatgagaatctcatttccttttttctctatcaggaaggagtggaatagtttttctataatatccgcccttgtggccacggttccaagccctccggtctcgccaagcatcttgcgcgcctttgcgtcccgggactccatgtatttgaccggattctccatagcagtcagcagggtcgcctcggtaaaccttgcaggcggttttgtcttccctgtcgtcagggaaatctggctgatggatagctgctctcctttcttaaggagcggcaggggctgttcgcaggactgccaggaggcatcgtcttcttccggatcatccaggaaagaactgtcagctgcgctggaggaatcatagatggccttccagccaggagatcggatgacctttcctttggcagtaaaggcctggccggcggcggaggccttcaaagtagtctgctcatattcgaaggccggatagaggacgctgataaatctccgtatcaccagatcatagatcttgcgctcatcgttgctcatatgctccagctggacaaattcttccgtcgggatgatggcatggtggtcgctgaccttcgcgtcatctacgaacgccttgcttgtctttataggcgcttttaaaagcgaaggtatgaacttcttgtaaggtccgatattgcatgctttcaggcgctccttgatggttggaacgatgtcggagccaatgtagcgggagtccgttctgggataagtcaggaccttatgctgctcatagaggcgctgcatgatattcagggtctctttggcggagaagccaaaacgccggttggcatcccgctgtagttccgttaagtcgtataagcccggagaaaacgttttcttggcggacttctggacatccgttatctgcagagcctgacccttgaggctggattccagatccgtgatgaaagaacgctgaaacgagcgcaggcttccattcttttcattctgccaggaccattttacattgccggcgacgcaggaaaggccatagtattcttccggcttgaaggtacggatctcttcttcccggcgggcaatgattgccagggtaggcgtctgtacccgtccgcaggagagctgggcattatacttgcaggtcagcgccctggtggcgttgatgcccaccagccagtcggcctcagcgcggctttttgctgcgtaatacagattattgtattggcgcccgtcttttaaacttaagaatccttcccggatagccttatccgtaacggatgagatccacagccttttgatcggcttatggcagccggacttgtcaaggatccagcgggcgaccagttcgccttcccgcccggcatctgtggcaatgataatgtccgatacatccttgcggaagagttgggtcttgacattgtgatactgcttggaggtctgcttgatgaccaccagctcccatttttccggaagcatggggaggtaggacatattccattctttgaactttttgtcatattcctccgggtcagccaaggttacgagatgccccagggcccaggtcacgatatatttgctgccctcgatggcacccggcaggttcttgtgacagtccagaacccgggcaatgtcgcgggccacagaaggcttttcagccagaacgagtgatttcatatatgatagtctcctttgatattcggttgaatgtacctattcaacatagcggatttaagccagtttgtcaacggatagcccatataagccgaatatcctgtcagataatttttacattttattggagaaaaataaaaaaaggagttgcaaattccagcggattatgataacatatatctcggtcacgcttaaggataagcaagatatggctccgtggtcaagcggttaagacatcgccctttcacggcggtaacacgggttcgattcccgtcggagtcatttgcgcgaaagcgctttatatatagaatggcgccatagccaagcggtaaggcaaaggtctgcaacacctctatcaccagttcgattctggttggcgcctttttaataagacgaaaattaatatctaacaaacttaaaaaagagccggcaacgagatgcatgattaaatgacatcgcgttgccagttttttttctaaaaatagtacgtcctttcatcctggcgctctatttaaagttcaattcttctgccttcctcggcggaaagatatgcggcatacataatctttgttgtctctagcgcgatatcgattcctgattcaggctctctgttataggccacatcctcagcaaacgcctgtaattccgctgtgtagcctcttaatgtctcctccgccacaaacacattgttccagccggttttacacttcagattctcggagatatagacgtcatccagtccctcatcgtccataaagaaacttctcatgttatttggaggcgtcatgaggcactcgagaactccgtcattcgtgatgagattaatatgattctgaattccccccatatagtgttcggaacttagtataactgcttttgtgccgtcggagaaggtaagcgtgatatgtccgaaatcttccacatcattaaatttactcaggatatgcttcttatcttcttccgggaaatcggctacaattcttccagtatccgcgacgacgcttaccggcttgatcttatagccgcgtatctcggactccacctgtttcagatacagcacgccagcaatcgggtgagagccaagacgcatgatgctgccgcctcctacgagactccagtctttggacagcggcgaggtagatccgtgaacgctgcattctgcgttcatatagatcacacggctttttttctttctcagaatttccgctgcctttacaatggcaggggaataaatatagttttccgcatacataaagagtttgtcgctgtttcctattttctcttttgcctccttgaggtcttttaaaattctttcatacatttttgcttttgaaactttgtcccccaccggcttctcatccgtctcatctccaaaatacccggtcagaggcttgtcgcagataacatgcttgcctgcctccattgccttataggcaaaaggcaggtggagaaacgggggaagcgtaatgtcaataatatccacttccgggtcggaaagtactttctcgtaatccgccgttgcatattcataattccacttctccttcaatgattccgcgcgctcgatctggctgtcaaccgcggctttcagcttgatatccagataattaacctttacccatgcgtttgaatgaaaatttccggcaaatccgcatccgattaccgccacaccaattgatttcatcatattgtcctccgttttttattttcaggttcttcacatctgagataagtataaaattaacgaagtgcatatacaatttcatttatctttataatttataacatttgtgttatgataattctaattaaggaggagccatatgaatctgaatcagctgcgtgccttctgcacgctttcccgtacccttcattattcccgtgcttcggaggaactccagatagcccagccttctctgagcagaatgatagcccagctggagaaagaacttggaaccccgctgtttgaaaagcaggggcgcaacattattctcacaaagcagggggaaatatttttagatcatgtcagccgcggcgtaggagagatcgaccaaggagtgtccgtattaaaagagttcattgatccagggcagggaacgattgactttgctttcatctatgcgctgagcccgtcctttgtcccgcatctggtgaagaaatttctggacaccccggagaataagaatatacactttcatttttaccaggggaattccagagatattattagaaaaataaaagaaggcagctgcgatgtgggattctgttcttacgtagaagatgaacccctcgtcgagctgcgtccgatcacgaggcaggaatatgtacttatggtctccaggcatcatccgcttgcgagaaagcataccgtgaccttaaaggaggcggcctgctatgactttatccttccgctggacaagacaagcttcgtggagcagcagttgaaaaaagccagcatcactccaagcgtatccagccgggtggaggaggatcacgccgctgccgcccttgtatccatcaatcttgggattgccataatccctaaaaataaaatgctggagcattacgacgtgaaactgattccttttggaccggaacctttgtaccgcgtattttacatggcaacatcaaaggggcacagttttactccagctgccggtaaattttaccggtttctactggaagagacaaaaagatagaccattcccttctcaatgtccttccacgatcggccttacaagttccagcggcatctttcggcctgtccatatgtgaaaacttttggcaccctggaagaggagcatgttctgcccgttcataatcgtgcagccgttttgctcagccatttcaagaaatctcgtctttctgggattgtagattacatccatgactgccagtcccggacggaagagactcatatcattcaccgggctctttccttccattttccccattcctacaggcgttgcatttccgaggacatcgctttgcgccacatgctttctgagaagttcttcgtcagacagttccagcacctctactttgcattccgtagattcattcagtctttcggccagcctgcgcccgctctcaaacgtagggtccttaatcccgaacagcgcgatttcccgcatgccgtccacagctgcctgggtgcagatggcagcgcttgcgcctcccgttccgatcagagtcatcttggcaccttcgatggtaacgccattgcttctaagcgtttccataaatccatatccatccgtattgtaacctttcagccggccatcttcgttcagcacacagttcactgaaccgctgagtctgccctccttgctgacctcatccagatactgggccgcaatctgcttgtttggcatggtgacgctgaatcccctggctccgagcgccctcagtccctcgattgcctgcccgagcgtttccggcccgacgtcaaatgcaaggtattcatagtccagtccgagcgcttcaaacgccgtattgtgaatctttggcgaactgctgtgctcaatgggggttccgagtactcccagcaactttgttttagccgtcacatctacactcatctcaaatagtacctcctttatgctatcgttcattctactgttcaagataccatttgcctgtatcaaaatcaaattgcaaaaatgtacgaattgataacattattgttatagaagtgctgaaaccgattatgccagggaagaaagcaccttggccttggttacgattccttttaactgtccatccttgccgactgccgcgatcgggtaagctgtttctgccgccaatcccatgatatccccaacaagcgcatccgtatctaccgtggggacatccttatggataacggaacgaatggagaggctgttctttttggcctcgattgcgtcggcgatggtaagaataccggctagctggaggctggcatccaccacatatacggtagagagttcgttcttcttcatcacccggatggcatggtctacgccgtcatcttccttaatcagggcctttggcgttatcatgatgttgtggacgcttagaaccttggatttatcggcattgttgatgaaggcttctacgtattcatcagcgggatgcgcgctcatctgttccggcgtgtccgtctggatcagttttccgtctttcatgattgcgaccatatcccccagcttgaaggcttcatcaatgtcgtgcgtgatgaaaatgacggtttttttcagtttgcgctgaatctgcagcagttcaaactgcatgtcctggcgtaccagcggatcaagggcggagaagggctcatccatcagaagcacgtccgggtcattggcaagggcgcgggcgatgcctacgcgctgccgcataccgccggagaggcttgcgcaggactggcgctcccagccgttgagccctaccatagagataacttccatggccttttcttcccgctgcgcttttggaatgcctttaacctccagcccataagccacattgccgagcacgtcccggtggctcataaggccgaaggactggaagaccatggagattttttccctgcggaatgtaaggagttcttttttcgaaaggtctgcaagatcctttccttcaaaaagaatatgtccataggtcggcttatttaactggttaaagcatcttaccagggtggatttgcctgagccggacaggccgatgatcacgaagatctggcctctgggaatcttcatattgatatcccacagtgctacagaaacgccggttttcttctgcacttcttttttcgtgcttccattgctcatcatatgtgatgcctccggcttgttaaggccatatagcttcgttacatgctgtacttcaaatacagtgtctttgcattccatattcatcatcctccctcgctattcttcactcttggcttctgactctgtcttgcttctggtgaaccatccctgcgtcagacggtctatcacgactgccagaatgaccacgcagcctccggctatcagaccccggccgatctccgtacggtttaccgcattcaagacttccattccaaggccccgggccccgatcatggagcaggtcacgaccattgccatggccatcatcaaggtctgattcacgccggtcaaaatagtcgggattgcctgtggaatctgcaccttaaatagtgtctgccatctggtagagccaaaagaccgtgcggcctccaccacttccttgtccacctggcggatgccaaggctggtcaggcggatgacggggactatggcatagatgacggttgcaatgactgcggaagcatttccaagcccgaaaagaagcagggcgggaatcagatatacgaatacgggcatggtctgcatcgtgtccagaatgggacgcacgatgcgattggcacgaggcgagttagaaatcagtattccgatagggagtcccagcagaagggcaagcacgacgctggcaagcacgatggagagggtgagtatcatctcatcccaaaatcccactatgcccaccaggcttaggattgcggcatacaggacgccggttcgaagccttccttttgcgcgccatcccgcaaggaataccagaatcaggaataagaaccagggaatgtgctccaacagccatttgaatccgttgaccattccgccaagcagggcctggatcttctcaaggacaggctctgcggaaaccgcaaagtggcggactgcattatcgatggcatcggtattgggcttatgtacgaaaggaaatccgctaagccagtcagtccctttcttattcgccccattctgaaggctggaagccatagtcttagcctgcttgggcgtcagccattcttcgatcaattcagggtgctgctttagcagccatctggcggcctgggagtggtctgccttatggtcctgcatataagcaagcccttcgctgatcaatttggaacctgtgtggtatttagagagaaatttgcagaaatcaggattagacttggtaaattcgttgcttgccgctaccgtaaccgtgactgccgggcaggcgccgatgccgtcctggaaggtggcagcgtcataagggctgtcctcaagcagcacaaggtcgtatttccccatcagccaggtaggctcccagtagtaggctacgaaaggcgtcttcttatcccaggcggaagtgatgacggaatcaagagcgggattgcttccgggaatgacatagttgtagtattgattcagaccataggcattgattttcttctgcatgatctcggtaacttgccatccgggaatcccgccgtagataatccccttcccgggatcctccggatccgcaaatagttccggatattttgccagatccttaacggtcttaaggtccgggtatttttttgctacatacgcgggaatatagagtccctgataattgtcatcaaagttgacccctaattccgtaaattttccggcagacagatcttcctgataagtggtgatattatccgtccattcttccatgtgtacatcgatctcattattcattaaggcttcatgggtgattggcgtagagcctggaacctctgaccaggtgtagccgaagacttcttctgcaatcaggcctgcaatggcattgttcagttctatggaatcccaccccacatccgcgaagacgatttccttcttttcatctgcggcagataccatagttacaggcgtcattgctgataacgataagactgcaaaaagtaacaagatttttttcatatccaatgccctcccatgaagatataaataacgtgcaggagtcagcggacaagttcggacacataactgagattggcagcgttacatgccactacaatgattgtgtcttcatgaagcagtgtctgcgggccgggagaaaactggatttccccatcctcgcggacagcgactatggtgccgcctgtcttctggcggaactttagttctccaatcgtctttccgacagcctcgctgcctggctggattggaaactcataagtccttagctggtcgctgtgctggaaacgttcttccagcgccatgattttttcaaaaaggctgctgatctcttcgttcagcttatttctctgaagcgtcagagtcttgagccgttctttcaatccgcgaagatcattatcgatcccgtactgttccacgtattcgatagcgagcgttcttgatgccacggttacgcctacattctggcggatatccactacgttcatgttagccagaagattcatggcccggcgtattgtctcggaagatacgccgtactgggaactgagaatggtacgtcctgaaagacgctgcccttcctttagttttccgtttgcgatctgggaggcaatatcataagcgacctgcgcatagacaggtacattcgtcgaaagtttcattgcttgctgttctccttgaaatatacatactgacaaccttattttaatgcaaaggttgtcgggtgtcaagcgcataggacgaaaagaaggcaggagtcctatgctcctgcctccctgaatattgaacttatggattcaaggttgcttttaccaattcgctgtgtgacagggcagatagttcttttaccttcccaaagtcaagccccatggcctcggttatgcggcggccgtaatcctcgtctgccagatagcagtgaacggcatggcggtattttacgttgtcggttaccggcgcgatgttgcgtgccgtattctctatcagcagcgccttcttctcctcggtcatcagacggtacaattccccgcctgcccggaagcagtcgtcggttggatcatccttcgggtcatacgcataaagcgcgcctgacaaatcaagcggcggctccatcacatccggctgggcggcccagtctccggcactgttaggagaataggcgggcgctccgccatagttgccgtccgtacgcataagcccatcccgatggtagtcatgcacttcgcatttggcctggtttacaggaatctggttgtagttgacgccgagacgatagcgctgagcatcgccgtatacaaagaggcggccctgcaggaacttgtccggcgagaagccgatgcccggtacgacatgggccggcgtaaatgcggcttgctctacctctgcaaaatagttctccggattgcggttcagttccagtacccctacttcatggagcggatattccttatggcgccagatcttcgtaatgtcgaatggattctcataatgcttcctggcctgttcctccgtcatgatctggacatacattgtccagcgtggataatcgcccttttcaatggattcatataagtcccgcccatggctctcgcgatccatagcgataattttttcagcctcctcatccgtcaggttcttgatgccctgctgggtgtggaagtggaacttgcaccatacccgttcattggcggcattgtagaaactgaaggtatgctcgccatagaaatgcatatgccggaatgtggcagggatgccgcgatcggacattacgatggtggtctgatggaaggtctccggaagcagcgtccagaagtcccagttattctgggccgagcgcatgcctgtgcgcgggtcccgctttactgcccggttaaggtccgggaaattatgtacatcccgcaggaaaaaggttggcgtattgttgcctaccaggtcccagttgccttcttccgtgtagaacttgcaggcaaccccgcggatatcacgttccgcatccgcagccccgcgctccccggcaaccgtggagaaccggacaaagacatccgtcttcttgccgggctcaaataccttcgccttggtccacttggtgatatcgtgggttacggtaaatgtgccatacgcgccccagccttttgcatgcattcttctctcaggaattacttcacggtcaaaatgtgccagcttctcaagaagccagacgtcctgcaatgccaccgggccacgggggccggcggtcagtgaattctcgttttccgctatgggagcgccgacttcattggttaattttttattatccatagtgttcctccttctgtaattatgaatccaaaaacaataatagttattataattatcatattccttttggagaaaaatgtcaataaaaaacttacggcgcattactgggctgtgtaatgcgccgtaagttttttattgatacgattggcattctatatagggacagatgcgtggcctatgatccggtagaattccggcggatacatttgcttagaagctccagcagttcttccacctggattggtttggagagatggccgttcatgccgctttccatggatttcttcaagtcctcgtcaaaggcattggcagtcagcgccaatatcgggatcgtacgtgcatccgggcggccggaggtgcggatgcatcgggtcgattccaggccatccattaccggcatccggatatccataaggattgcatcaaagtatccgggcgcgtggctgacaaaaagatcccgggccttcctcccatcatttgcacagcatacggtaaatccattcatctcaagaattgtctgggcaatctcctggttcagttcattgtcctctgccagaaggattctatagccatggaagtcaggaagcgccgccgatggctttttactactgttggccataggagaggccgaagccagagcatattcgaaggaaagggtaaagtaaaatagggagcccttgcctacctggctttgaacttccagcgtaccacccatcatctgtaccaggctccgggaaatagacagtccaagccctgtgcccccatggagggaggcagtgcgggaatctgcctgctcgaaggcgttgaagatccgctccattgcggaagcttcgatgccgatgccggtatcctggacagaaaacttgagcacgctctttggcgaagtctctaattcctccacacgcaaggtgacagagccttggctggtaaacttgattgcgttgccgatgatattgaccagcacctggttcaagcggaggctgtcggcgatgaggcatctgtccgtaacacgcatgtcctcaatccgcagcaaaagccccttctccgtggcctgggcccggaacaaggattccaggcttgataatagatgagagagatccacggtttcatagttgagttccaatttgccgctttcgatgcgggacatatccaatatatcattgataaggccaagcagataggtgttggccgattcgatcttctccaggcagtccagagtcttttcgcgatccgacagcacgcttttggcaatcgtggtcatgccgctgatcgcgttcatgggcgtacggatctcatgggacattctggagaggaaatctgtcttggcctggcttacggcatccgctttggacttcatgataaaggaaggaacaatcttaaccatctcttttaacaatttccgctgctcaggggtccattggtaattctcacgatccacttcaaaactcatggatcccgcatattccccatagttccatatacctgcgtggagacaggaagggaagcgggagattccttccttcacattgtggtccgcaaggccttcttcatcgtacatagtggcgcaggcgtcaaaatcctccgcagcggcataaaagttgcacccaagctgcagatcctcccggctgcgtgcccactggtaagagaagtgatagcttaggtaagaaggattggcttcgataatggatacccggtcaaaatgatataatttgccgatcctggaaagcagcaggaagaccgcgtcatccaggttctttgccttgccaagaagatccagcgcaaaagcgacaaagtcgcccttgggctgcgggatatccggctcgatggcattgacaggatgctcgtccgtatacagctgggtcaggaacactccaagttcattggacgtatccagatagcaggcagcctgtccctttccatgttctttgacatatttcaaggtactctccgcacagcggtagagcgcatgatactcacccgtcacttccgtgctgcacatgccgatgctggcggatacgtgaatatccttttctggagtagccaggatactctgtacctggcgggcaattctgggtccgatgacggaggcctgggccttattactgttcttgacaaagaacatgaattcatccccgcccaggcgcatggaaatactgtcctggggggattcggcacggagaatgtcagcaacctccagaaggagggcatcggcaaatacattgccttccttctggttgatttctttgaaattatccatgtcaagcagcatcattaccccatgctcatcggctggcctgtgcgccaggtaattttttaccatctggatgccgctttccttattataaaggccggtcagttcatcctgagagcgggcttttatcagcgctgcctctatctccttctggtgggtaatattttctgtaataccgatgaccagctgaggagagccgtcttcattggcaagtatgacagaaagggttacccggcaccaataaacgccgtcttgcgccagaaattcacaagatgaagtccgctccccctggcttatgcactcatacattttatagaaggcctcatgatacgcgggatccacctggtcagtggcaaaatcatagggcatattgccatacctttcctgacaatgatagatagagcaggtgcgtggcggaacaaggcactcccgggtttgggggtagtagtagaactcgcaggttgtggtatgttccagtgccagatggagaatctcgttgctggcctcaagctgttcggataagcgccggttgctcagttctgccctttttcggctgtcaatgtcaagaaatacgctttggatcacctgttctccgtcaatatccagaatgacctccgcgctgccgatgatccacaagggggtaccgcctttttgaaggaggcggtattcatagggactcttatctcctggagcttggagggtctcgatctctttaaggatgcggacccggtcttcactggcgataagggccgtgagatcccagttcttcttggcccagaattcttccggcgtgtatccgaagatacggatggcttcccggttcgcattgataaatatgactccctggggcgtcagcttatactggacgatgccgcagagaacagactcgaagaggtggttgtacctccgggcctgccgttctaatccctccctggattctacctccaaagagatatcacggataacgcttatgcagaccttacgtccatcttcggaaagtccctttttgccaatatcattcacccagatataatccccattcttctttttcatgcggtattgaatctcataggcactgcccttcgaaaatgccttcgcaacctgctcgtccacagccttacggtcatccggatggatgcagttaataaccatgccattaatggcacggttaaattcatcataggtatagcccagataggacagaaggaagtcattgacatagtagagaggaaagcctggctccagatatccgcctatcatgccgccgggaatactctttccaagaatgtccagcgccctaaagccaagctgacggtccagttcggcacggccgatagaagaagaaggaaagaacttagcctcttcctgcaaggcatccggggcggaggcatggatggaggcgatccggtatagcccgccttcctcgacgcaggtagcggtgacctcaaacctgagcgcatcggtaccgggaacatccgggaatacagaggcgacaaggaggactacggcacagtgagccgcgatagaggtttcccggatgtcgtcatattcgatccggcaggagtacgggacttgagagaatgtggcccgcaatgcctggatcaccagatcctttccattccaatggatgtcctctgtgaggcattttgatgcacgttctatattccgctgaaccaggtatgcatgaaggaattcctgaaccacttcggctgccttgcctgactgaatcatatttccacctctttccgggtcaaatacagagattgtcccccttgtagatatttattaccattataagccaggcaatttaaaaactcaatgtgggaatgcgcttttgatgatttcctgacatgaatcagcgcgtaaaatgcagtggaagaacgaactgcattttacgcgctggattaggctagattatttgaattttttacgtgatagcaggatgagagccgccagcgatgctgccgcgagcaagccatactcattctgtcttgcggtatccccggtcttggccgccctggcatttgcagaaccgccgctggtattttgggccgatgaagaactgccgtcctggccgcctccatttccattaccgccatgattgccttcgctctttgcctgcttcttataggccaaagagtaaagcgagaacttgtctgtctcaatggtgatcgtagaatcgtcgttatccagatcgctaagaatatccgtctttagcgttccatcctcctgttcatggacgcggataacagagaataccagttcctccgaagcgcttaagccttcccggaatttttccggaatctgaatggtgaggcgtattggcgcagaagcctcgctaagctgcgtctcagcgccgtttcttattttaaatagattaatatctaagtgtaaagccagtatctgatcctcggccagcgcgttctgcactgcctcggccaatgtatcgtcgaccgcttccagttccttcatgcgcaagtggaagccgatggtattcccggcgttgatatcctgtctgtctacaggatctaagagcttgtcagccatctgcgcggaattattcaccgataccttcacatcgggcgtggaagcatcaacgtggacttcgaagtcggtgtccggtccgggaactttcttaatcttccatacggattgcgtatccgttacttcgtagtccagttccccatccttaagggagaaccatcctgcgtcggaatctgtatcatcgcaggaaacgatgatatcgccagccttgatgccgttgtcgatcagctgcgtcggcacgccgtcctgctttccgagaaatgccgtgatatgaagcggctgatttaaggtaatgctgtcaaaacaggtaaccgtatcggttacgaaactgtcgttcagtatcagagtggaactgccgccgatggcttccggattgccggaattctccactcctccccagatatgctctgcggtagcggacgtgagcgtgacggctgtgctgtccccgccagccttgcttccctcggctccgtcactgcatccgccggcccatacagaaggatagcactgcgtgccgccgtcgcccatttcttcacagaagtaaccgcttatatcatctagggcaatatggatggaaccagccttggcagaagctcccttgctggcatcgccgccgccgtagatgctgccagttatggctccggtatcgccttcgctgatagccaggttaatgcttcctgacacattggcctgggatccgtttccattcgccgtgccgccgccgtatactgccgcggctacccagcggtcaaatatatctttttccacaggtgttatggaattggtgatatggatggcagtctcgccgacatttgccttgccgccactgctggcatcgccgccgccaatggtgtatccatataggttggaacaattttttatatcaatagaaacctttccggatacattggcaacagaagaaccggatgcggaaccgcctccgtataacatcatcatctcattgccatccacctggatatcaacggattcagcattcgcctgggcgctgccgcctgccgcgtctgcattgatatttgcatagcctgcgccgtagacctcccggatatccacctgagataactgaatctgtaccgctccttttacgtctgccctggcattgccggatgctttgctggttacggaagcccaaccgccgccccggacggagtaagtccgcccgcatacggaagtcctggatgaccccacatcggcggaggcatcataagccccgctggcaacggcgtatccgcctccatagatattaccatggttgccaacaggaattgcagaaatatctatagaaacactgccggtaacattggcactggcgttcccggacttgccaacggcatatccgcccccgtataccttggaggcatcggcatttcctttgacagtgatagaaacgctgccatttacatctgcattgcctgtcccgtcagaatatccgccgccgtagatagttcctatgtttacgctgtcaactacgatattgacatccccatttaccggctcattcttgccgccgccgtagatggtcaaagaacctactggcgttgcaatcagcttttcattgccagaaccgtcatagatataggccttctggtcagagtcatcttttttgatgacgaccggaacgccgtaagtatataaagtatttccctctaaaataagcggcaggtcgtttgaagtcacctcttcagatgctggtaccgccaaaaaagcgtcggatgttccttccgtctcatctgcctcacccggatcttcctgtggatccctggtttcgatgccgcctgtaatcgttattgtctcgtttgatttctcccctgtactttctgacgagtcgtcagaattttcctgcgcataacaagtaaacgcaagattagcagtcaggatcaaagcggtcagaaccgccaatacccggccatgtcttttcattatgtattccccctgtattatattattttgactattgcttaaccgtatctgcgataccgtcaataaaacaataatctgctcccttccttcatcatattcttgactttctgatttgtcaacaataatgacgaaaaattgtgtaataaatgacgaatttttgatagaattttacataaatcatttttttgtttattagaattgtacaattgtggtcaggggaatgtaacaatggatgcttgacatctttcgacatttagtaaagaataaactattataaagtaattatcggtttattaatgagtcaggggcgggtgaatggtatgttaaaagtattgatagcagatgatgagaagatgatatgttccttgatatcccaattgcttgactggaatgcgctggggtacgagattgcagggatggcatacaccggcgtggatgcctatgaaatgatcataagagagcagccggatgttatcatatccgatatcaggatgccgggatatgatggcattgaactaataaaaaggacgaaggatgccgggatagaggcggagttcgttatgatcagcggctttaagcagtttgagtacgcgcagaatgcaatgaagtacggtgtcaaatattaccttttaaagccaatagaagaggataaacttcaggagatcgcagaagagatcaaggaggcaattctgagtagaaaacagcatgatcattatcggaatcaattggaattggagattcaggagacccgggataagatgaagaaacggttcctgacttccatgctgttcggagagcaggaaagcaggaagattgccgactgcaacagcattaaccgggaatacagcaccagttttaaagaaggcgtattccaggcagtatttgtcaaggtcgatacggatgaaggggaggaagaaagcatcggctccatgatcgagaaactggagaaatatacggatattctgggggacgtgtgcgaggagcatattactacggagatgcattcggggattataaccttggtgaactataagttcgagcaggaggctctggtcaggaagaagatagaagaaatgtatgaagagattaagaaatatatagaccggttcgaagggttctctgtggtactgggggtaggccgcaagatggatcatttcctggaatccaatctctgccttcagacggccattgacgcgatcaagtatcggatccgaatcagcaataccaatatcatttatctggagaattatcagtttgagccctatgatattgagaagatcgtgacagaaggcaagaagcaggcctacctgtctaaggtggtatcaggcgatatcagaggcgcccaggaatgtctggccgccacgctcagagagatcagatacagtggcggcagttattctcccattctgtttttcgacatcctgatcgcatacgttgatttgctgaccgattattgcaagcagcaggacttgttcagcgaggaatatgaaaagaacctgaaaaaatggaacataagcatggataacatcagaagcgagaagatgctcctggaagttacggaagattttatcaaaaaaacactggaaaatgcggcggaggagaagaagtcaaaagatatcaagccaatccgggaaataaagaagtatatcgaagaaaattatatggaagacatcagtcttggtcagctggcggaattggtggatatgaatgcctcatacctaagttccgtatttaagaaggagacgggcatggcttactcggagtatctgattctctgcagagtgaagcaggcaagccggcttctggtggagacgaatctaagcatcggcgagatcgcgcaccagtcaggatatcaggatgccaggtatttcagcaaacagttctcgaagcaggtagggcttaagccgtccgaatatagaaaactgtattcataaaggggaagacatggataagagaaaatattcatcgaagaagataaagaaaatcatcctggcaggagtgctcatctacctgcttctggtgattgcctcggtgattctgatgaccggcaggatagaaagcctgcatctgcgcctgctcgttattctggcggagattgcgctgggggcggcctactatacggttttttaccgaagcatctacaagccgaaccttcggctggagcagatcatcagggatctgaaccatgggcagctcaaagaggatgacgacatgcttcgagagatcaaaagtatcatctcctccctggattctatggccatcaagcagaagaacgcggagatactgatgaagaatgccgagattaataatcttcaggatcagatcaatccgcatttcctctataacacgctggaagtcatacgaggagaggctttgcttaacggtgacaggaagattgcggacatgacggcgtccctggccaattatttccgctacaacatcagtagaagagagacgttcgtattcctgaaggatgagttaaagaacagcatgaactattttaatatacagaagaaccggttcggggacaagatatcctgtcagatagtgtaccatgatgtggaagaaagccaggtagagaactgctacattcccaagctgctccttcagccggtgatcgagaacgccatctatcatggactggaacttaagatgggagagggaaatatcaagatacatatcacggcagcggattccagcctgaagattaatgttgcggatgatggtctgggaatgtcccaagagaaggtagacgaactgaatcgggattatgaggacggggaagaagaggaatcttccgagacagggggacggcggcataacggcgtcgccatcaggaatattaaaaagaggctgaaactgtactgggaggatgcggcgtacatggtgatcgtcagcgacctgggagttggaacacaggtgcatatatcgatgccgctgctatatcagattgaggaatatatgagttgaccatgaaaaagaatgttctgttattgaaaaatattacaaaagaaaaggccggcagcaaagtgctggatcaattctatgtcgagatcctgagcggcgagatcatgaatctgatcgggctggaaggaagcggaaaggaagagatatattctatccttttcggtgatgaatgtgcggataagggagaggtatggtttgcgggaaagaagtatgaaaaagggaaggaactgcccgtcgaaagatccaacgggatattttttatcggaaatcaagaactgatcattccgaacctgagcgtggccgagaacctgtatattattgagaagatcaattatttccagttcagcgtatcaaagaagaagatggaactgcaggcgcgaaggatgctggaacagttcgagattaagatcgccccggataaaaaggccaatgagctgaaccggtacgagtgctatatcctgcgtctgatgcgggcatatgtgaagcgtgccaggctgatcgtggtggacgatattctggacgacttttcctttgagcggatcggccagatcgtggagatactggaacgcttcaagcaggaaggcatatccgtgctgtggatcaacagttatccggacgcgattacggaaagttccgataaggtcgtggtcatccgtcagggaaggaactgtaagatgttctataaggaagagtacgacaggcagaaagtgtttgagtgcatgattggaaagaaaggtccaaaggagtcggtgcaggagtctaaggcaggcagcaggatcatcttccaggcagagaatatacagaatgattattttgatgggctggatttttgctgcaggcagggcgagatgcttggcatctatgacctccaggataagttcagcagagaactgcgcagattgcttctgggcaggagaagctatagcggcggcttgatcgtagacgggtcaccctataaggcggattctgagtataaactggtgagaagccatatcggcgtggtggatgggaataaataccagtcactgatcttcccggatcttactgtcagggagaatatggagatggctgtttataagaagactaccgtgtgcgggtgctttattaacggtagggtgaaaagatatctggatagaattggaatggagatctgcgagaatagccggatcaaccaggagatggtcaatgtcagcagaagggatgccatgcagatcatctaccgcagatggcagcttacgaagccgaagattctattctgctttcagccattcctcaggctggacgccgtatccaggcagcagctggaggctttgctgctggaatttaaaagcaagggaacggggatcgtattaagcagcgccaatatatctcatctgctgccgctgtgcgaccgaatccttgtcattgagggaaatcggatcatcagggaagtagaaaaagaagcattttccgagtatttctaataaaagtgcacatattccaaaatccccggcattgtccgggggcctccgcaaggttatactacacatatcaaataaccaaaaggaggaaaaagaatgaaaaagatgtggagaaaggtgctggcagcagcgatggttctaacaatgatcctttccctggcagcgtgcgggagtaaaggagacgataagtctgacgacaagaagtcatccgagaaatcatccgatgtaaagattggctttgtagtcagcgatatgtcagatgcattcttcgcgcacctggtgcagaagatgcaggatgatgctgacagcaagggcgtaacgctcacagtaaaggagtgtccggagatcagcgataagattaccggaatcgagaacttcgtggaggctggatgcaccacgatcatctgccacgttacggatgcagacgcgcttaaggacgcggcaatgaatgcagaggacgccggcgttaaatttatctcttatgattctgatatcgagggaacttccggattcatcggaatcgacaactatgagtatggatacgctattggaaagaatgccgcggactggatcaacgagaattttgaagagtctgacaccgtcaaagtgggcgtgtgcaactatccggattatccattcctggtaaccagagaagaaggaatcctggcagcattaaaagaacttgctcctaatgccaaggtagtagttaccgccaaagcaggctacacccctgaaggcgtggacgtaggagacgcatgggtgcagtccaactctgacttaaatgtggttgtaggcatcaatgacgcaggcgtgctgggcgtatacgaatcattcaaatcagcgggcattaagaatgacaagctgggaatgtttggcggggatgccgtagacgatgctctggctgcgttaaaagaaggcggcgcattcaaagccacggttaccacgaatatgctgctccatgcggactatttcatcgatatggcaatcgagctgacggaaaaaggaaaactggacgaaagagaagtcctgttcccgcttgatccgatcacgccagaaaatgtagacgagtatattgcaagtcaggaatagtaaatgacaggaattaatggtatagcgtacaacctataccattaattttttaaggaatggataatggatgaggcggtgactgatacatggatcatatattagagattaaaaatgttacgaaaagatatccgggcgtagtagcccttgataacgtctccctttcagtgaggagaggggaagtccacgcgctggttggtgaaaatggcgcggggaaatcaactttgatcaagattattacaggcgcgatcaagcctgatgaaggaagcatcatataccagggtaagaattacccggaactaaatccgatcctgtcgggggagattgggatagaggcgatctatcaggaattcaatcttgctccggatctgtcggtggaagaaaatatctacatgggaagcaaggtgaataacagcctgttcatagataagaagaagttaacggaaaatacgatggaaatcctgaagtcgctgaatgcggacattagcccgaatacaaagatcaaggatctgacggtggcctatatgcagctggtagagatatccaaggcgcttgcaaagaatgtaaagctgttgatcatggatgagccgacggcgccgcttacggacaacgaggtggagatactctttgagctagtcagaaaattaaaagaaaaaggagtgtccattatctacatatcccacaggctggatgagatattcgaactgtccgaccgggttacggtcatgcgtgacgggcagatgatcaagacggctgagatacaggatattacgaagaatcagctgatctttgacatggtgggacgtgaacttaccgagacctatccgaagcgtaatccccaatatggggataagctgctggaagtcaaaggcgtatgcgggccttccaaccaggagacatccttctgcgtaagagaaggggagatcgtagggcttgcgggcctggtgggcgcgggcagaaccgagatggccaggctcattatcggagccgataagaaatattccggcgaagtctatgtaaagggaaaaaaggctgtcattaattcgcccaaggatgcgatcgagaatgggattgcctatgtgtcggaggatcggaagaaccagggagtactgcttaagatgtccatccgctggaatattacccttcccatacttaggaagctgtcgaaatttatattcatcagccagaaagaggaaaatgcgtgcgtaaataagtataaggatgcactgcggatcaagacgccatctgtcaaccagctggtgggaaacctgtccggaggcaaccagcagaaagtagcagtggcaaaatggcttgccagcgaatcaaaaatattgattctggatgagcccacgcgggggattgacgtgggggctaaacaggaaatctatgaattgatcaatcagctgacccaggaaggtcttggaatcatcatgatatcctcggagatggaggagattatggggatgtccgaccgtatgctggtaatggcggaaggaaacgtggtaggggaactgcagaaagaggagttctcacaggataagattcttagatatgcatcgaatataacgacttaggaggaacgcaaaatggataagtttaaaagttttataaagcagtatttcgtattggtgatattaatattcttgattatactatttggctgcctgcagccggaatcatttttgacgatgtcaaacttctttaccgtagtccggcagtcttctatcatgggaatcgccactattggcctgctgttcgtcatgatcgcgggagggatcgacctgtccctgggatcggtgatatcattggaatctgtcctggcagcagtccttttgacaaagttcgggatggggctattcccggcatatgccctggggcttctggcgactacgctgatcgggctggtaaccgggatcatcattgtaaagaccaacattttcccgatgatcggaaccctggctttgcagatcatcttgcaaggcgccgcgtatctgatctgcggaggaatgccggtatccaatctgccaagttctgccaaggtggttgggcaaggctatgtggggatgattcctctgccagtgatcctgttcatcgttgttattatcattgctggaattgtgctgaaccgaacctacattggaaggcatttttacgcaattggaagtaatgaagaggcggcaaggctctccggcatcaatacaggcaaattaaaggtggccacctatgcgatcggaggattcctgtcagggcttgcgggacttatcatgcttgccagaatcagttccggacagcctacggcaggaaagaatatggaaatggactgcctgacagccgcggtaatcggcggcgtcagcctgaccggcggagaagggcgcatctctacggctgtgtgcggcgtattgatcatcggcgtgctgaccaacggcatgacgatccttaatatcagcgaatattaccagctgatcatcagaggatgcatcttccttggcgcggtatgcctggatggaatccagaagcagctggcgggcaggaagaaagtgaagaaggtggcctagtatgggggattatcgaaagtatttggaaccggaatatggggaagcagcaccggaagtcgagattatggagccgcaggccatggatatggagcacaagaaggagtggcggacgaagaacaactacgaatccgtggcggcaatgacggcggcttaccagcggtgcagctgctatgagaagattatgacggtacatacggaagagacgctgctaaatggaagcgacgggcccatacgccttcggatctatacgccggaagtgaagaagccgtgcccgacagtcgtattctaccacggcggcgcgttctctatgaacagcattgatgtatacgagtatgtgtgcagatacctggcctgctacggaggcatgatcgtggtggctcccgattaccacctggccccggaatacaagtttccgaagggacttaacgaggcatatgatacgctcgtatggaccagcgagaatataagggattacggaggagaccccaaaaacatcagcgtctgcggcgatagttccggcggcaacttcgcgaccgtagtctccatgctggcaagagaccggaaaggcccggctgtccgcaggcagatcttgtactatccattgacaacgaatgtggagagcgagatgacagattctgaaaaacgctatggcaaggggtatttcctggaatataattgtatggaagacccgatggacttttattttaacagcgaggaagagaaagaaagcccgctggcttctccgctcctatccggaaatctgaaaggactgcctccggcctgcttcatatccgcccagtgcgacccgcttctggatcaggggctgatgtatgcggcaaagctagaggacagcggcgtaagcgtggagtaccatatcatggaagggatggtacatggattccttaactggacgtacgggaagacattcgacgcgttaaatcatgctatccggttcatccatgggacggattgacggatcaaaggaggaattatatatgtcagtatttcaggaaatctcagattatatagataccatatccgtgatagatacccattgccataaactgccccggcaggaaaggtttccctcaggaattcaggatctggtggaacattcctacctgggatggtgccaccgcgactgggacggcacgaaggaggctgctgcggaatttgtaagaggcttaaagcataattcctattttttctggatcgagaagagccttcagaaactgcttggtacagaacaaaggctggatgaaaatacgtacccttggtttgaccagaagattagggaattctcttcttcccttgcatcggatgatgaatttctgcggaatgtctgccattatgacaagatcatcctggacggatattgggagccggggacgaaccttggcaatcccggtctgtatacgccgacctaccggatcaaccagtttctgttcggatatcagccggatacggtggatgataacggcaacaatcccttccttgtatatggatggcccaaagacctggagttcgaccagtatttagacaagattgaggagaagatcacagagaagatggcgcaaggatgcgtggcgttaaagtcatcccttccctatgaccgttccattcattttaaggagcggacctatgacgaggcgaaaagaggataccagaatccagatgcctcccgggaggatatcgtggcattccaggattatatctatttttatatctgcaggattgcggcaaagtatgatattccattccagaaccataccgggcttggcaatctggaaggcagcaatgccatgcttctaaaggaagtcatcagcaagaatcccaagaccaggttcatcctgttccatggaagcttcccctggacggacgacgcgctggcgctgatccacaattattccaacgtgtacgcggacctatgctggctccccagcatatccactactacggcaatctacttcctgaagcagctcatagagactggaaaggcagatgccatcacctggggctgcgactcctggacggtgatagaaagctacggcgcatatctggctggccgctatgcggtggcaaaggcgctggcggacctgatcgaagatgcgttcatgaccttggaggaagggaaggaactggcggaaaatatattccgaacaaatgcaaagagaatttatgatatataagatattttaggcgaggcgtgggcattcatatagtggatgcccgcgtttttttgtggcatacgaaatttgctgcctatatcataaaaaccctccgggagacgggctggcattttattgacttgtacggtataatatagtgcaagtgcgaaaggagtttttttggaaaatgataccttaacaacaaaagagttgatggatagactggggttaaagcataggccgacttttcgaaagaactatcttttaccatcaatgaaacttggattagttgaaatgacaattccggacaagccaaacagcagcaggcagaaatatagaaggaaggcagcaagatgacagagattcagaagcatagggccgacgagatgacgcccgtagaaagaaaaaaagcaatcgaggaggggaaatcctacgaccgcgtgccctgcgtccctttcatgggagaactgaagggagtgcttagcggcatcagcgtgtgggatctgtcccatgacccggagaagatggcggaggcggagatcattcctttcaaccgctatggatatgaccggatggatatcgggcctaattccagagggatcacagaggctctgggcggcaaggtgatctatcccgagaagggagttccctatatggatgcgccgctcatccaggattatggaaggctcgactctatggaaccagtagatgcccggacgaatgccagaatccgggactttgcccggacggcgcagattcttgcagataaggcgcttcccatcgtccctgtggaaatgagcatcggcggcccgcttacgattgcatccaacctgcggggcgtggagcggctgctgcgggacttaagaaagtgcccggacgacgcgctgaggctgatcaggctggttgcggacagcgagagaagctgtatcgatctggcggcgcagtacggcatggggattgccatggctgacccggtggcaaaccccgcccttatcggcccgaagatgtatgagcggttcgtatatccatttacgaaggaactgacggattacgcgtatgaaaagaccgggaagaaggtatcgctgcacatgtgcgggcagacggagcggatctgggactattttaaaacatatgaactgaatgaggtaagtcttgataatatcgttgatcttgaaaaggcggcgcaggaattaggtccgcatatcccaatcgcaggaaatgtagacccggtagagatcatcttgaacggaactaaggaagagattacgcaggcggtcagatcctgcatcagcgctggccttaaatcccggaaggggtatgttctggcatcaggctgtgatattccagagaccaccaggccggagcagattgacagtttcatggaggcggcgagagcatattttcgcaggaaggaagcgcgatgatttctagtttgaaagacagccccttattccgtggcatgacgggggaggatatcgaatgctgcttgaagtgcagccatgcgcagtcagtcaggtatgacaaggatgagatgatcttctgccagggcgatgctccggaaaaactctcggtgcttatagatggagcggtggcagtatgtaacgattccacggatgggaggcggagcattgtggcatccattgaaaaacccggggaattattcggagaggtctttgtattcctgggccaaaaggagtatgagcactatgcccaggcggcggttccctcaagaatccttcatatccccagggagtatttctactctacctgtgggaaagcctgcgtttatcatgcgaaattaattgccaatatgctggcgatcttcgcgcagaaggcatactatctgaatcagaagatacagattatctcctgcgcgacgcttcggcagaagattgcgaagattctgctggagtatggcaaggcaggcgaaagtccggccattaccatgaaccgggaagagatggcggacttcctgaatgtagcccgtccgtcactgtccagagagttgatgaggatgcagggggaagggcttgtcaaggtgacaaagagaggcatctttgtcccagattcgttggcattgcagaaaattttatgattttgcgatccgtaacatatgttacggattttttttgacattattggtagcattaggacatcaaggcaaaccagccattcaaaaatcaaggaggaaattactatggagaataaaatgttctgttaccaatgtcaggaaaccgcaggctgtgcgggctgcacgcagataggggtctgcggcaagaagccggagactgcagccatgcaggatctgctggtctacttgacgaaggggctgtcggcaattacgacgcaattaagagccgaaggcaaggaagtgcctgcggatgtaaaccatctgattactttgaatctgttcattaccatcaccaatgccaactttgacgaggaggcaattgtggaacgtatcgataggaccctggcaaagaaacgggatctgctggcgcttacaggcagtaaagactcgctgccagaggcagcccgatgggactgcaagggacgtgaaggctatatgggcaaggcagtccaggtaggggtattgtctacgaaggatgaagatatccgcagcttgcgggaactgattacctatggattaaaggggctatccgcctacagcaagcatgccaatgcactgcttgaagaagatgaggaggtggacgcatttctccaaagcgccctggctaagacgcaagacgacaggctgggcgtagaggaactagtggcgcttgcgctggaaaccgggaaatacggagtcagcggcatggcgcttctggataaggccaacacgtcggcctatggaaacccagagatgaccaaggtaaatatcggcgtcggtaccagacccgcaatcctggtgtccggccatgaccttagagacctggagatgctgcttgagcagacgaaagggacagggattgatgtctatacccattctgagatgctgccggcccactattatccggcctttaagaaatattcccactttgtaggcaactatggaaatgcatggtggaagcagaaggaagaatttgaaagcttcaacgggcccatcctgatgaccaccaactgtatcgttccgccgaaagacagttataaggaccgcctgtataccaccggcgcggcagggtatcccggctgcacgcacattccgggaaagatcggagaggaaaaggacttttctcagatcatcgcccatgcccggacgtgccagcctccggtagaactggaacgcggagagattatcggcggatttgcccacaatcaggtgctggctctggcggatacggtagtggaggcagtcaagtcaggcgcgatcaaaaagtttgtcgtgatggcaggatgcgacggaagggccaagtcccgcaactattacacggattttgcgaaagcgctgccaaacgatacggtaatcctcacggccggatgtgcaaagtataagtataataagctggatctgggcgatatcggggggattccacgagtgctggatgcagggcagtgcaacgattcctattctctggcagtgatcgccctcaagctcaaagaggtcttcggcctggatgatatcaacgatctgccgattatttacaatattgcctggtacgagcagaaggcggtcatcgtcctgctggccctgctttacctgggtgtcaagaacatccatcttgggcctacgcttcccgcgtttttatctgagaatgtggcaaaggtactggtagagaactttaacatcgcagggataggaactgtggaagaagatatgcagcgtttatttggagaggaacggtagaaaaagcctggatggaacaggttcgtaattatagaaacaatcaataagtacgattgtttatagcagttagcaatttgtgcgcggcagcatgccaatggtagaatgttcttgaacagtataataaaatgatagggagaggacgaaagatatgaaaaagaaagtcattagcatgctgctggtttccgccatggctgtaacattgatcgccggctgcgggaataacggggcggatgaaaagaagtccgaaggagacggaaagacgctggaggtgtgggtcgctccgctggacgacgacacggtgaacaactggaagccgcttcttaaggattgggagaaggagaacgactgcacggttaacgtaaaagtagtgccctgggacagttatgaggagacatacacgacagcgcttaactcaggcgaaggaccggacgtgggatatatgtataatgagatgttcccgtcatatattgattccggagcggttgttgatatgtcagaatatgttaccgatgaggacaaaaaagagtataaatatctggaaaacggatatatgatggatggacagtatggctggccgctcgtgacgggagtgcctttcgtgctgtactataatgaagacatcctggcagacctgggagagacagctcccgagacttgggatgatttcgtaagaatctgcaaagcggcaaccaaggatacggacggcgacggcaagattgaccagtacggctatgcagctggaatgagcaccagcgatgtgggagccatgcaggtgctgaacgcatactattacagcgcgctgtggcagaacggcggacaagtctataaggatgacctgaagtccgtagctttcgctgatgaagccggaacggaggcattgacatggatcaaggatctgacccagtatatgaatcctgatttcatgtcccagtcatggtcagaggcatttgccaatgtgtttggagaaggcaaggcggcattcggcgtataccgctcatcccagacggatgaaaccatgtttgccgagacctatcctgacctgaaatgggactatgtgacttcccttaagaatgtggactatggaacattcggagcaaccgactgcctgacgctgatgtccgcggcagatgataaagaccttgcaatggatttcatcaaatacgtgacgggcgctgaattcatgaagcagtaccatgcaaaatgtcccggcgcggcacttaccgtcagcgagccatatgtaggcgacgagaagatggagcgtatctatacagaggacattgataaatggcatggccttcaggtaggcccctgcggagtggacatcttaacgcagctttccgctgacttccagggcgtgatgacggacgagatgacggtggaagaggcgctgaaggaggccgaagattacgcaaacggcctgctggatgattactgggcagataaagaataatcaatgagatacaaaaaatgtccgcttttattgcggacatttttttgagaggaacggtatggaaaagagaaaaacgggaatcaaaaacgtagcgccatatgcttatattacgccaatcaccctgatccttgtgacatttgtaattggctccgtcatcatatccgtcgtgcttgggtttaccaaatataatattatgacggagccagttttttcgggacttgacaattataaaaggctgcttactgacagcaagtttattaaggcgctgaaaaatacgctggaactgatcgtcatcattgttccgctgcagacggtgtcgggcatcctggtatcttccttcctggtggcaaaccgcaagaaggtgcttgggaagcttgccaattgcatcgtgtttattccggtgctctgcgcggatgcggtggccggagtcgtatggagggaatttctcaatggaaaacttccggtggtggaacacttctttggattattcgggatagagccatccatgctcctgggcgatgccaaaaaggcgctgatcgtcgtggggcttgtggcagtctggaagtatatgggttattacgtggtcatctattcttccggcctgctgtccatatccgatacctattatgaggcggcaaaggtagatggggcgggcaggatccgctgctttttcagcatcacgcttccaatgttgaagccgaccataatactggctgtgttcttatccctcaccaattctctgcgctgctttgatctgatcttcaacctgacaggaggagggcctaataatgccacgacaacgctggtgctgtatgcatactcctcctgctttggaagcagcaaggcaggctatgccatggcaatatccaacatgctctttctcgtggtgctcttgatcgcattgatgcagagaacgttgatgagaagagatgtctcggaactatagggagggaatatgaaagcagtagcaaaaggtttaagaaatggaatagattccatattgctgattggaattatcgtggtgaatgtggtgcctttcgtgtacatgttcatgatgtcattcaagtcaacgatcaatgcacgcgactttgatttttcgctggataagctttctttcgtccagtaccagaagatattcgcgatggacaactttgaacggtatatcttcaacagcgtctttgtggcagtggccggggtgatattgacggtgacggtgtgctccttggcgggctatgcatttgcgaaaatgaattttaggggaaatgaccggctgttcctcttcctgatactgaccatgatcgtgccgtcggaggtgataatcgtgcccctgttcctgattacaaagagcctggggtggctgaatacatttcgggccctgattctgcctcttcccacggcatttggcgtatttatcatgcgacaggcaatactggatgtgccgcaggacttgatcaatgcggcgaagattgacggctgcggaaatatcaggacattttttaaggtggtgctgccgatggtaaaatcatccgtgctggcattgtctatatttacctttgtgggcgcatggaacaactttatctggcccctggtggcgtgtaccaagcaggagatgaagaccctgcctctggcgctgagtcttatgaagacccagttcaatacggacgtagggcttacgatggcctgcgctgtggtgaatttcctgccgccctttatcttctacatttttatgcagagtaagttcaaggaaggcattgcgctcagcggcataaagggataaagtagaagtatgtcaaagattatatacgtaaacgatattccgataacaattgaatacaggaaagtaaagaatatcaacctctatatcaagccgccggatgcgcatgtgctgatcaccgcgccgcgacaggcagcggaaagcagaatccgcgaatttgccgaaggcagggcgcagtggattgaaaagagcaggaagcgtatgctggattccagagagaagatggcggacgaactatccggagccatcacgaaggagcagatggagaggattacggaaatggtggaagcgtatgcacgcaagtgggagccggtgatgggcgtgcacgctacccactggaccttccggtatatgaagacccggtggggcagctgcacggtgaataccgggcgtatccgaattaacacgaggcttgcctactacccggacgaatgcctggagtatatcgtggtgcatgaactgtgccatctgatagagccaagccataacaagagattccatgcatatatgacaaagtatcttccagactggaaggaaagaaggaagaagctttgtgaaaaaggaagtgggcagggacggtcctagaactgaagggacagccccacgcccacttcttttatttccatatgcttcatcatctctgccttggctcttaaggagacgcagtggcagggatacatagattctacagaggacgattctaagaagtctatcgtcttataaagacgcgcatctgcgtcaaataaatgaaatcccccgataatgccggcgatccggctgcagccaaatacttgcctcgcatattctacgatgttgcagatgccgctgtgagagcatccggtgatgatgaaaagccctttcccggtccggcatacgacggcagagtcatccaggacgcgatccggcacttctttcccgtccaggagaacggttccggtgccgggacgttcttcaaacgggttcgaagatggaatctcgcctaaaaagcagcagttttcagatatgtagcaaggcgtccgggaaggctgatacaggcagagtttggcaatctcttcttcggagaagggcgagccgatgtagcggccctgctcccacctgggcgcaaagcagcccgggtgcgcgaccagcgtcgcgtttggcaggctgaactggctaaacaggtatttcagccctttgctgtggtcatcgtggccatgggacagtacaatatgcgtgatctttttcaaatccactcccaacgagtgcgcgtttcgaatcataatatcggagtatccggcatcgaataggatcttcttatcatcaatctccacataatagctgacgcctggctctcccaggtaataatggtcaatgtaggtgttattgtctaccagaacttgcaatttcataacgaattcccccttttcatccggtatctatgcataagcgctttatctgtataaagtatatcagattccagagggaaaacatagacaaaaggagggatatatagggacatattgagttttgaacttgattatgatataatactgaaatatatgtggacagagtttggggtcagtccttggatgggaaattagaggagaatacgtcatgaagaagaaaataatggcaattgcggcaggagtcctggcttgcgcactgatagccgccggatgcggtcggagcggcgaggtcgtaagctacgacgcgcaggaggaagaggtcacgaccattacctttttcggatataaatacgagccggagaatgtgaaggtcatcgaagagatcatctcatcgttcatgaagcggaatccggatatccgggtctcttatgagagcctgaagggaaatggctattacgatgcccttgcaaagcgcatggcttcagggaaaggtgatgatgtgttcatggtgaatcatgatatactgcttgatctggaagcccaaggccaggtggcggatctgtccgatcttgatacgatagaggaatatacagaccagatgctcagccagatgcaggatgaaggcggaatctatggtgtgccgaccattgtctctgcattcggattatactgcaacctggatcttttgaaagagcataagcaggaagttccccggaatctggaagaatggaaagaagtatgcgaatattttaaaaaagaagggattacgcccattatcgccaacaatgatatttccctgaagacattggcgatcggacgagggttcttttctgtgtatcagcaggagcgccaggaggaagtctttgcccggctcaacagcggggaagagaacataagccagtatttggagccgggatttgccctggtgcaggaactgattgatgaagaatatatagatgcagaaaaaacgctggatacgatgaagacatccgatgatctggaagaatttgcaaaaggcacgtcgccctttatgctgacaggcgcctgggccgccggacgtatggaaggaatggagtcggactttgcgttcgaggttgacccgattcccgcgctggaagatggcggatttctggttattaatgcagatgtgcgtctgagcgtaaacgcggacagcaagcacatggaggctgccaaaaagttcgtcgagtattttacgcaggaggataatattcagaagtttgccggccagcagtcatcctttagtccgttaaagagcggaaaggcttcgacggtgagcgagatgcagccattggtgccatgctatcaggcagggcgcaccgtgataggcgcggatggacttttgaaccttcccatctggaatctgacggcagaggcctcgcagatgctgctgtcaggggaaagcctggatgagacgctaatgtggctggatgagcaggcagcgcaggaaaggagaatgccagaatgaaaagcgggtcttccggaaagataaagaaaaagattgccctgatggccataggtgttggagttattttaagcatgatcgccattatctttgtccagggagtaagggagcagttgtggcagcagtctgtcagcacgataatggaaagtacgcagcagggctgtaatacgcttaaggtacagctgcgtgatgaatatgagtccatgaactcggtggtaggatatgtaaaggaagttccggcaaatcagaaggagatgctggaagacatcataggggactatggaaaggtcgactcaggcatcagcctgtacctggcggatggcagcggctacccttccggcatcgggctggatgaggaggtgcaagaggcgttggtgggcggcggcaaggagaatgggattatcaatcctcatatcagcagcgttacaggcatcaatgtatttgatctgtatgtaaaagcaaacttgcaggatggaacagaaggctaccttgtaaaggaatatgagatcagccacattgtagatacgttcagcctgtcattttataatgattctggtttttcgtatgtcattgacgatgaggggagcgtccttatcaggccgcctcatccgaacagcaataagacggtgaagaacctgtttgatatgctaaaggagtccgagaacgattcggcaagccttgaaaaattttcaaaagcacttaaaaattccaagagagggtgggcggtctttgactatcagggggaggagaccgtattctgctacacgcctctgcagctggagtccaactggcttgttgtatccatcatccctaagaaggtggttgatgaacagaccaaccagatactggcccgtacgctgatcctgatcgtgtgcattctgatggggctcgccctcttggctgcttattatctgcgctatgccagccggacgaaccggaagctgcgtaatcaggcggagtatatcggccatttgtataacgcagtgccggaaggcgtcgcgctggttacggtagagcagccataccgtattctccagttaaaccaggagggactcaggcttcttaactaccctgaggatgcgctgaatgacacgccaaaaggaaagagccttgaagaaatactccatcccgatgattacggctcgattgcagagattttctgtaatgctgccgaaacggaaggaaagcatatatacgagagcaggcttaataaggaagacgaaagccttttctgggtgtcgggaattgtcgaaaagacacgaaatgagaatggagacccgatcctgatcgccacattccatgacatcacagaggagaagctggcagaagaagcggcagaaaaggagaagcagcaggagcggatgatgctggtgggcgcagtctctaatatatatcctgtcattatcagcattaacctaagcaaggatacgttaaagtttatctatatcaagccaggtctcatggcaagtcttgggcagcaggaatcttatacccagctgtacagggaatttgcagggatcgtgcacccggatcatctgggagaatttgaacacaggtttgagccggactgcctcaaggccgccttgaatgggggcagggaagaagtattcctggaagccaagcagatgctggaagatggaaattatcattggacatccacacagatcatccatgtggacaatccatattccgaggataagctggcaatcctgatatcccgccggattgatgagcagaggcatgaagaagaacagcaaagacagatgctgcagagcgcccttgacagtgcccgcgcggccaacgttgcaaagagccagttcttgtctaatatgagccatgatatccgtacgcctatgaatgccattgtgggcatgactacgattgcagcgacgcacctttatgaccttgaccgtgtaaaagaatgccttggcaagatcgctctttccagcaagcatctgctgagcctgatcaatgatgtgctggacatgtccaagatcgagagcggaaaactgtcgctgggagaagagccattcaactttgcggaactgatatcagatgtcgtggaattaatgcgttcccaggtggattcgaaacggcttatgatggatgtccatatgtcggtgctggagaacgagaaagtaatcggggatcccttgcgtataaggcaagtttacattaatatattaagtaatgcagtcaaatatacgcctgcgggtggaagcctgcatatagaagtaagccaggaaaagagttccattagagggcggcagaaatatatattcaagtgctcggatacgggaatcggcatgagccaggaatttttagataagttgttccagccttttgaacgggcaaaagactctacgatcagccggattgccggaaccggcctgggaatggccatcaccaggaatcttattgatctgatgaatggagatatcaccgtagagagcgagccaggcaaaggatctgtatttacagcgtctattccgcttgaaactcaggatgcccgtcaggaagatatcccggaagagtggctgggggtccacagcctgattgtagatgatgacaggcagacctgcgagaatgtgacggacctgctcaaggatatggggcttcgggcacagttcgttacagatggggcgtctgctgttgagaaggtaatagaggaaaaggatacgcaggatcctttccaactggtaatcattgactggaagatgccggatatggatggcattgaagtgaccaggcgcatacgcagggaagtgggacctgacattcctgtgatcatactgtctgcctatgattggggagagatcgagcacgaggcgaagatggccggtgtcaatgcatttcttgccaagccgttctaccgttccaaagtgtgttatcttcttcaggggctgagtgaggaaaagaagcctatggaacagatggaggaccagggcgggcagttagagtttaagaataagcgggtgcttctcgcagaggataatgccatgaaccgggagattgcccatacgctgattgaggagatgggcgttcaggtagaggatgcctgtgacggggaagaagcggtaaagatggtggctgcatccggggaaggctattaccacctcatatttatggatgtccagatgccaaatatggatggctatgaggctaccaaggcaatccgggcattagacagagaagatgttttaaagatgccaatcgtggctatgacggccaacgcttttgaagaagatgtccgggacgccttaagcgcagggatggatgcccactttgccaagcccatcgatattcggatattggagcagattctctataaatatctaggttccccatcctaacatacaaaggaaaaataactggagaaagaagcatatgaaaaaggatacaggattctatggaatcgtgcaggaatattttgagacaaggattctatatggattctacgtgtatggagacaggctcccatcaatacagaaactctgcgtcatctttgccatggcgccggccaccatccggtcagcgctgggacagctggaaaagcagggatatataaaagtggatgcaagaaagggatcagaagtcatctatcaggcatcgcccgctaagttcagggaaaatgcggcaagatatttcggtgtcagaagggaagggatcgcggatctgttccagtcggccgaactgctttttgagcctctgtgggagacgcggatcattatgagcaatggcctggcgcagaatctttactgggaggtcatacgatatctgcggtttccgtatctcatggatatagaaaagcagagggtcatctgcgagaatcttaagaaacggtcagtaagcgacatcatcgcctatttgagaaatgaatttgaaagcgcttacaggccggcggcagaagagattctgacatttattgaggaagcctgcaaggagtatcccctggatgaggaagaaccgattccgttctggtggagcatctaccggcaaaggccccagatacggtatacgctggtgtccgatatcataagggatgtcataagggggcgatatccacagggctcttatctgccatctcttccgcggcttgcggatcaataccaggtatctgtgaataccatccgccgcgcgctggatattctggaggggcttggagtggccagttctctccagggaaaagggacgctggtacgaaaggaaccgggggaaatcaatatggagaagacggaaatacaggagggaatgcgtctgttccaggacagcatggaactgctggaagccacgatccggccgatatccgtctatacgcttaaagcggcagggggcagaaaaagagaaagactggcagagaggctggagaggctggagcgagaaaaaactagttatgtatgttttgaggcgtatctgtcgtttatagaagaagaatgcccatccggcgtcattagagaatgctacagcaaactcagggaactgctggcatggggatatccatttgctgtaatccgggcaaggaagcgagggcttcatgaagaattccgggaggtcatcaagcagatggcagcattcctgaggcaggataagattgaagaattcgcggatacttgggagcggctgattcaacatgaagaaatacaaaaaaggtcttgaagtaaaacttcaggaccttttgtttaaataatctagagattggattaggaatagcaaaatcttgggggtgcttctaaagcatattttgtattccaagaacaatatatcacggagaaacttctttgaaaatagttttatgttacataaattagtaaaaaaattgtgcctgaagcacaaagatgctataataatgcggacgaaagaaatgaaaagacagacaggcgggtgtatagacgtggcagtagaattgaaggaactttatgcaaagatcagtccgcaatatgacgtgaaactgcatacgacagggtgctttgaaaaaatgattggatgggtccatatggtggaggatccggaatttgcagaactgctgcatggagatgaactaatctttaactcaggcctgaactatacttcggatgaatggcttcgcagattcgttgaggcgctgaataaggttcatgcaggagggctgatcgtatccctctgggggacgaggaccatctcgcaggaaatcattgattattgcaataagataaagtttccgcttttttctgcatcgtggaagacgccttacatcgacattatgcggatgttctccgtgattctcctgaaaaacgagcagagggagacgaatctgatcgctgcattaaagaacgccatctactatccggagaatgaagaactgtatctcagccattttgagagaaatggattctttcgggatatgtcctatacgatcgtcatactcagctgccatgcctacgatacggacaatgggaatgaaaggctgctgaggatagagaagtctctccattatatcctgaaaaatgtgatcgtatatgaagagaaaggctgcctgatcatcctcgccgcaggctactctctttcaaagatccgctccgatttccagcggctgtgccagagagattctaacatatacgtgggaatcggcacgacagcggatcagatccgggatatccacaagtcttatcataacgccaatacagcctaccagctgactaagacagccattcctaagaatctgctggattacgacgagctgggcatctataagatattggcggatgtaaaagaggtatccatctatccggcgtttgtaaaggagaccctgggggctttgatagactatgacaaacagaatcaaaaggagtatatgaagattctggatgaatatttccgcaatgattgcagcgtcattgagacctcaaaagcgctgtactgccataagaacacgctgacctacaagattcataagatccgggatattctgggatatgatattcatagcaacgagaaccgtacaaagattatgatagcgctctatatcatgaggctgggggagattggaatataacacgcatttagaactgtctgacttttaaatttgtggtataatgttgggaacagcaagataaaatacataggaggcggatgcaatgaatgagaatcggataaaacggaatcaattattaggcgggcgtatcgttcagggactgaagtcccgcaatatgaatggctattacgccgagacgaaagaagacgcgcttaagaaagcgctggagtggataccagaaggaagcacggtcgcctggggcggctctatgtcgattgcagagatcgggcttaagaaggcaatctgtgaaggcaattataaggaatataaccgcgatgacgccaagaatccggaagaaaagcgtaagatcgagctggcaagctatgactgcgactttttccttacaagcgccaatgctataacggaagacggagtgatggtcaacatagatggctttggcaaccgggtatcggccatagccgcaggccctcgcaatgtcatcatgatcgtagggatgaacaaggtggtaagggatgtagagaacgctgtatcaagggccaggaatgaggctgcgccgatcaacgcgcagagattcgatattgatacgccttgccacaagacaggagcctgctttgactgcaagtctcctgacaccatctgctgtcagatgctggtgacaagattctccaaagttcccgaaagaataaaagttattctggtaaatgaagaattaggcttttaagatgttgactaaatcccgggcatttgttataatacaaatgctcgataaggcgccatagccaagcggtaaggcaaaggtctgcaacacctctatcaccagttcgattctggttggcgcctctacaataagaagcctcggagacttaatgtttccggggcttctttcatgaatttcttttttaggcgatggagacgtccatgtcatccagcagccttcttatgcctgcgatatccagattcgtctctgccgcgaggaattccacctcttcggcggtcagattgtcaaatcctttatccttgacgttcatctttatatacttgcggcgcatctcatccatgtcaacaggaattgtacgaatgtcctgaggcgtggctggaatgatgatgttcgtgcctggaatctcttcttcatgctgcccgatcctgacatctacgccgtgatcttccgcaaaggtcagctgggcggtgtgggcctttccggctcctgtatattcagattcctccaccactatgatctgatcctcatccatggtgcgtgcgaggctgatcgccgctgcaagcccggtatttcctgccggtcctctctgcaggccttccagctggttgagaagttcggtagcataatagacttcgccttgggtgaccgtgtagaattcgtccatgtatcttaacggcctcgctgcattcagcggcacatccacgctctccgggttataaagggatgggaatccatagcctgtatgcccggtggagaaagactttctggcaaatacagcatcgtcatgggagtcaagatctgccagattgacggaaacgcccaccatctttccggtgtagccggacttgcgcaggcctcttgcagcaccggtaaagttaccgcctccggcgtgagttaccaggacgacatccggctggcgtccagcctgcgctttcgcctgctccatgatctctgcgccgatggtctcgattccggcgatgctaaaggggagatacaaagaagcgctgaagtagccaaggtcatccagcagttttaagatgacataggtaaatacttccgggccgacggtatattgctggacctctgccccgtatgactcgcatgcccgccccttttccagggattcgggctgcccattgccggcatcatcgtagacttcctggcagatgatagcctttaagccgcggcgggcggcctgagaagctacggcagcaccgtagttgccgcttgtagatgcgatgactccggggtagccggattttttcgcctcatagacaggaagcaaggctctgcggtccttgaaacttcctgttgggttatcggcctcgtcctttaagaagattctggcgcctttgcccttgggggaaatggagcggaccagccggttgatattattgagttcgatcagcggagtgctgcccacgtaaacttcggctgcaattttgcgtatctcatccatggaaaggccaacaatgtccatgaatttctcataatcccaagccaggcgcccggatttgaattcatcgtaattaatattgactgaatggaacaaaatgtctttgttcttgcctgtaatatcggaaactgcctgattactcatttttatccgcctccttcataattttgcgtacttcatttccggcgtgcatcagggttggctgctgacgcccgaaactgtgatcatactggggccacagctggtagagcgtgccgctaaccacacgtccggccagagtctcaatgttcaccgtatccccgattgaggccgactcatccattaggaatccattgatccagcatttcaaaggtacctttctggtgctctccggcaaggatttaagccgttcctccggggtcaggatgatctgcatgattctgacccagtcattttttttcgcaacttgtttcatatgattattctcctttcatagtagtatcgtttgcctgctccttctttccgggacgtttaattaccgtcttatagaagcctaccgccataattacgaggccaagatagccgagcagcggatatacagttcctaccagtttgctgaatggaaccagcccagccacgaaagccacgcatcctgctacgagcgtcaatatcttgaacttggtagttccatcctcagcgaacctgacagaaaacccatacaggatggggacagaagtggtatagacggcaaagagcaggatgaatgcaaagataccgcctatgacaggactcatctgtcgggcaacttccaaaaatggcacctccatggcagatacatccacgattctggataaggtggccagaaccatgaacagaatcgcaacgccaagaagcgagcctccgagaatgccggatttacggattagtttttcatctttctccccgttgccgatggaagccagcgctggaactgccggcagtacgcagtaggagatgtagatgaatgcggaagaccaccagaagggggttgccttggcgatcgtaagcccctgcatattagcgcctgcctgcgagatgcctgagagattcgtgctgatggttccaatggatatggccagtgtggcgataatgatcagcggagataagaatccaagcgcattgagggcggaattgaatcccaggattacggttccgacggtgaggacggcgatgatgactctgccgaacatcagattgattccgaaatactggttcagcgatgcgcccccgccggcaatcatgattgacaatacgccgaacaagaaaaatacgagtatccagtcaaatactgctcctaccttcggcccgcacaaataagtaaagacttctttgtgcgaattggtatgcagcttatggccaagttccataaacatcgtcccgtaccaggcgaataatacgactgctatgatcgtgcccacgatgcctatgtatccgtaactgacgaagaactgcagcgtttcctgcccgctggcgtagcctgctccgataatcgcgcctacatacatgcctgcgtaacgaatgcagtttatgatccatttgtttgcatggtgctgtttcgtttccatagattccctcctctttcagaactttttatagtcgctttcaaaacgttttgagtgatataagcgtaaacgatataagagtaaggtgtcaaaatttaacccggatctggccagagagaagaaattggacggcaaaatgagcagaaacgaccggttttaaaaaagttggatttatgtagagactattttgtgcgataatttattaaaacagggggaatatattgctgatttggatgagtttataataaaattgtgactgttggcatacattgtgctattattatgacattataagaagtcaagggaaaggaggaaatccgatgaataaacatgaactagatgaaatgctcgcagaaaatccgtttttagtattgagcgatgtcatctaccagtctctctataatgacatcatacagttgaagatgcccccggattcacgactgaacgaaagcaagatcgcggaagaactagggataagcagaagccctgtaaagagcgccttgtcgaaacttgagaaggacgggctggtatataagaaaagcggcaagatacttgcggtatcctggatgacgaaagaggatggctatagcctttatgaggcgcgcagcgctttggaagggtttgccgcctcccttgcggtaattcggatcactgcagaacagatgaaggaactggaagaattgaccaggcagtatgtggcggtatgcaatggcagtaacaaagaactgaatccgaatgactatgcggatatcgaccataagttccactctctgattgtaacggcttcctgtaatccttacatcatgcgaatgtacagaagcctggagggctatcttctgcactacagatactgcctgtattactcgcttggaccggagaagctgcagcggatactttatcaggcaggaaagcgtcaccaggctattttcaatgccttccagatgggctttaccgatatcgtccggcacgaggtggaggaggatgtccacagcatgctcaatgcctttaaccaatgggaataaatgggatacggccgatgacaaaaaatgccgaaaaaatgtaatcttctttattcttaaaatggcagacagtattaaaaaagcacggtgtccgtaaaaagacgaaaccgtgctttcttatgcttatgcggaaatactctatacatccaggggcggcgcagccaggccgcggctctggtaaacggcgtcccggttggcgatggtagtatcatagtgcgtcttgtctgccatttctttatagttgtgaagcagtatcctccaggcactgtcgcagaactggtcgacctcaagcgccagggaagcctgctgtgctgattcttcgtatttcccgatggatgcgtagtaggaggccagcgcgacgcgcaggctggcatagcggatatcatactgatcccgcagcagattggcccagtcgcacttgacgtcctcaaagtatttgccccggtacaaggaggctccatagaggatggagtccagattgccggaagtgatggagccggcctgttcttcggcatccgcgaacagatcggcatcacaggtgacgcttccaagatccagggaatagtagccgcttttatactttaaagagatatcagttccggtctctttcagaaactggcgcaggtagtagttgcaggtgttgagattggacagggccttttcttctggaagggtgctaaagagagtatccagaagattcttccggaaaacgccgtgggggcggttctggagataaagcgcgaataattcccgcacctttgcggtccgccactccggctgcggcgcgcccgacccggtaatctcaagttttccgaacgcatgaagcataggggaagaagacggcattgcctgcggtgctgtggacagggcacccaaagtattcttgatgcggtgaatggatttttgaaaccgttctttgctgactggctttaacagataatcggtggcatctaagtcaaaggccgatacggcatattggtcaaaagcagttacaaagatgatctctatcttatctgcaagcctggactgaaggtccgaggccagttccatgccattgcgcccgggcatggcgatatcaaggaaggccacctgaggctgcacctccctgacggattccagggcatcatcggcgttatcgaacgagcccaccagttcaaagtcttcataatctttcagcagataacttaatttggccagcgcaggcggctcgtcatccacgatgatggtgcggtatttaggggtgctgttgattgctgctatatccatattctagttcatcctcctgaaattttgaattcagcggtatgcgaatcaggattgtggtgcccgctcccggggaagtctgaatatccaaaggaatgccatagtggagcttcaggcgccggctgacattgcgaaggccgatgccgccctgatatccatcctgttcttcatttagcaggttggcgatctttaccggctcgattccgactccattatcctgaatctcaatgtgaatgtattcttttttttctgtaatcgttacctggatctgaatctcctggtaactgtctaatgtggcatggcgtatcgcgttctccaccaatggctgtatggtaagcggcggaagagagaaactgcgcccggttttttggaccagcttaaattgcagccgtctgccaaagcgggcctgctcgatatggacgtaggaatttacgattccaagttccgtgtcaatcgtgacaagtccgcggtttacgtcgtttccaaagcatcctcgaagatagattgccagatcatcgatcagctcgctggctttgacgccgtccgtaagcgcgatggcgctgatggtattaaatgcgttgtacaaaaagtggggcctgatctgagcctgaaggaacagcatctcattatcaagcgcggatttgacagactgcttcagcgtaatcaggctgaaaaccctggtgcgaagctcgatccggtcggccggctttaccacataatcattcgcccctgaccagaagccggtcaggatttcctccgccccgtcgcaggcggtaagcagaagcaccggaagttcgaagtgagagtagcgcttccggatgatctggcacaattcaaacccgctcatctctggcatcattacatctaatatgatgatatcataagaagatttctcaagcaactctaatgcttcttttgcactctttacgcaatccatggaaaaactgcagtcttcgaaaatggtacgtatgatattcaggttatcctcgttgtcatctacgaccagaagggaggctgacgttcctttgaagtcctccagataattctggcttttgtaggcagaaccggcctgggctgctgctgcgttttccatggaattgtgatctggcgtgcaggcatccagacagaaggtaatgcaggtcccctgccccggcttagtccattccacgtacacgcttccgttcatctgctcggtcagctggcggaccaggtatagccctagccctacgccctctgctttccgggcggtatcatccagacgcacggacttgtcaaaaatccggctgatatctttaaccgacatgccaatcccggtatcagacacagagacgtataccttcccattcatgcgcttgcttgaaatggtaatggtgccggaatccgtatattttacggcgtttccaatgatattgttcaggacttcccacaattttgactcgtccgcgttcacccacagggcgttcttggagagattgtttttaaagatcagcttcgtattatcggaagtatagtagaatacttcgattacggcatttacctcaatgtccaggttgacgggctttaggcttacgcttctgtgctcggaggaatagaacccgtacaagtcgttcaggacactgttcagtttcctggcaagcattagggcgagacttaactgttctttggcggtatccggctctccaagcttggaactggcggattcgataatgttgataatgccatgcagaggcgtccgcagttcatgggacgttgcggatatgaactcgcttttaagcttgtcggtgactaccatcctgcgggcaagccttgcattgccggtatagatccgggagaccttgagggccacgtaggcaagctgggatgtgacataggcgaccaggaggaagatgtagctgctggcatatgcgtctgcagagaccattccccggctgttaaagtataggagcgcgaaatagctggagcagaaggagagcgacagcatcagcatcagcgcgctgtagcttttattccagatccgccccaggaggatgatggaagtatgaaggagggaggcggcaaagtaggttccggtcaggatcttcatcattggcagatactttcctgggcagagcaaggtaaggaccagaagaaacggaatgatatacaggtatatcttcaaggtcctttgcaagatgcccttggtgtagcaattctgcctggcaagaaggatcatgcacagccccatcaatgcaaaagacaggacgtagatcttggtaaatatggcataagtccacgactgtaccggctgggtcagcaggttattgctggaatagaccagatggaaggaaagcataatagtgaacaggagcaaataagcggtgctgcccatctgaaccttaaaaaacaaaaggaagatcaggaggatcgcaaggattcctatactcataagcccaacggattcagcgaacttaaactgagaggcaaggcggtagccgtctatctgggtgccaaaatatatggggcttgtaatgccggtatgataattgctgaaattcgatacctggatgatgatctcatgggtctgccgcataatgtctagcggaaatacgatatactggttgtccttttccgtctcagaactggcctttaaggaagaagtaaatccaatatccgacagaagccttccatccacatagatgcgcgcggttccctgtactccggcaaggcgcagggaatacaggtcggtggtgccgaggaaggtgaaggtaagccggtaggtgccatagccgaaggtattcggaagggttcccggaagcttccggtattcgggcgaataatgttccgcgctggatgcggaaaagtcggaggaaaacaggaagcggctgtcataatattcccactccccattcagcgccactggcagcctgttctcgatataggcggcgttcagccttccggatcttgccttgccggcgtaatccggattgatgataaagagtgtaaaaagcgccagaagcgatacgacagacaggacccatatatggaaaggagccagtttcctgcctcgcagacggttgattgaagaagatagcctgtgatttgatttgtccataagtacctccagtcagatataatgtcacatttggtaatattatagcatgtgtcagttaaaatgaaaaattgattgtgcaattttgataaaaaggttgtgcgcgaattgtctaatatgtagatgtttagtaaaatgtttattgttatattgactattctgtatattattgtataatgaaaccatcaaaaatacaaggaggaaagaaaatgagaaaggtaaaaaagtggtgtgcccttctgatggcctctgtcatgctggccggcaccctgaccggatgcgctgtagatgaaaagacgcaggaaaatggcagcgagcaggcgggagacgaaggaaaaagcgacgaaggcggcaagattacaaagagcgagaaggaaggcagcttcaaggtaggcatcgcagccagggagattaccaatgactacaaccgcaacatcgtatcagcttcccagaagatgatcgaagatgcaggcggaagcgtagtcatcgcggatgcccaggcagatgtgcagaaacacaatgagaacatcgagaatctgatcaattccggaattgacggcctgatcgtccatcttggagacccggagcagatggctcctttgatggaagaggctgaaaagaaaggaatcccggtcatcaccaatggcgtaggctctccggtagcgcataccatcggagatgtaaatggagatgatccgctgatggcaaccctggcatccgacgcgctgcttgcaagcatcggatatgcaggagacgtatacgttgtgtgggttccgggagcgccgcttctggagacgagaaagagaatcttcgaggccgttgccgctgattatccggatgttaagatccatgaagtgccggcagagcataatcctgcaaaagtgcagacgcagatcgaggagattctgacagcaaacccggacgaaggcagcatcgcaggcatttttggaacgtatgaccagctggtatccggggcaagcgaagcaatccgccgtgcaggaagaggccaggagatcaagatggtagccattgacggggacgtgctgggattccagatgctgttccaggaagacagcccattcatctctaccgttgtaatggatacggaaagcattggcaagcagtctgcggaacttctgcttggcgtgatggatggaagtgtagatcctaagacgatttctccaaagattcctgccagctgctatgtagcaacaagaaagaatggcgtagaggcagcagagatgaagtggggcaagaatttctgggaagatgccggacttgtgaaagaagatgtagaaaagcaattcccgaaaaaggaagacgtgatcgtagcgcttccaagtattccatagagacttgaggattcgggcgagagtaatctcgcccgtagcaatttgaaggcatatatagaaggcatatatttaagaaagttggtgaacgaatggaggaaaaccaggtattactggaatgcaggggcatatacaaaagctttggcaagaataaggtgctccaggatattaacctgcgggtaagaaaaggcgaggttcatgccctgctgggacagaatggggcggggaaatcaacattggtaaagattattacaggcgtgtattccatgaatgcaggggaaatattcatggacggcgagccagttcggataaattctcccaaggattcggaaaatgcgggaatatcaatcattcatcaggatcagcaactggttccatttttcgatgttaccaggaatgcgttcctgggctcggagatcagaggaaaaggcgggaagctgaactttaagaagatgaaggaactggtagacgaaaaactgaagctgatcgaatctgatttcacgtcagaccagcagatatcctccttaagcgttgggcagagagagcaggtggccatcgtcacggcccttctgcagaatccgaaacttctgatcctggatgagccgacggcatccctgagcagccgggaaatcgagaaactattcgaggtcatcgggaaactgaagaaggaaggcgtaactgtcatctacatatcgcatcatctggacgagatcttccggattacagacagcataaccgtgctgcgggacagccgcatgcaggggacattttcgacagaaagcatctcccgcaaggatgtggtgagcctgatgatcggtaaggaactgaaggatttctatccaaaagaagaagccgtgattggcgatacggtcctggaggtagaagatgtctactcaggaacgctggtaaaaggtgccagcttcaagcttcgaagaggcgagatcctgggacttgcgggcttggtgggcgcagggcgtacggagacgatgctggccatgtacggagtagagaagatgaagagcggccaggtaaagattgacggtaagccgtttgctcccaaaacgccgctggaagcgtgccgggcaggaatcgcgtttatcccggaagaccgaaggaacgaggggatcgtatcgcagatggacattgcagagaatctctcccttgcttccacggatctttgggccagaaaaggaatcattgataaaaagaaggagggcagcaggtttgaggagatccgggatgcgctgaatatcgtgtgtaccggacagaagcagctggtgggcgaactctccggtggaaaccagcagaaggtagttatcggaagatggatgacgggcgacttcaaggtgtttatctttgaccagcctaccacgggagtggatatcggggcgaagacggagatctataagcagatggtcgcactggcgaaaaagggctgcggcatcatctttatttcttcggaaaatgaagaattgatggggatctgcgaccgcattgccgtgatgacaaaaggaaggatcgtcaaagagttcgatgccggaaatgttacagagcatgacatcctgtactggtcggcaggcggagaggaagaagagaaaaaggaggcaggaaatgttggacaagaagaataaatctaattcggcaaatatcggggcgcttcttctcagcaggggaaccggccttggaatgattgtcatattgtgcctgctgggacttagagcgccgctgttctttgagatgacgaatatcatgacggtactgaagcagggaagcgtgctgacgatgatcgcgctgggactcacggcagtactgatcggaggcgggttcgacatgggcgcaggggctctggtgcagcttacctgcaacctggcggcaggtctgctgattgcaggcaccagcgtggcggcggcaatcacatcagggatcgcggtagggtttctggtaggcctcatcaatgcgtttctggtgatcatcgtcaagataccaacctttgtggcgacccttggaacgatgttcgtcatgcagggggttacgtcctggtataatgacggaaaagcgcttaccatcaaggcaatccccggattttccgtactggggcagggcaggatcgccatcataccggtaattttcctgatcgtcatcgccgtgtgcgctgttctgcattatttcttcaagcacaccagaacggggcttcggatgtatgcaaccggcgagaatccggcggcagccacccttagaggattgaatacgaagaaatatcttcttctgtcatacctgctgtcggggctgattcttggttttaccggggttcttcaatgctcttacaattatggcgcgtccgctatcaccagcggaatggatttcctgattcaggcgctgtcggcggcataccttggaagtacattttccaagacaggcgagctgagcgtgattggaacggtcatttccggcatgtttatcgcggcgctatccaatgcgctgatcatcaacgggatatccaaccagcagatatcgggagtacttggaatcattctcatcctgtcaatcttgctgacggtaatcaagaaacgcgaaatcggacaggtaacgatattctagaagggagggacagacggtggaacaagtaaagaaagagacatctttttcaaaagaaaaagtgttggcattcatagcaagacatggcgcgattataggtatctgctgcgtgttgatcgcatttcagatcatcgagccaagatttatgaggatagacaatatattgggcgtgcttaattccagttccttattgatcgttatgacctttggaatgacgatggtaatggcggttcgggggattgatctgtccatcgcccaggtggcggacgcggcgggcgttgttgcggcaatgctgattctgtcgggcaagaatttcatagtcgcgattctgggagccatgctgtttggcctgctggtgggcatcatcaacgcagtgctgatctcctacctgggggttccggcgatcatcgggacgctgggcatgatgttcatcgtgcggagcgtggaactgaccctgacggatggggcgcagccccagatactttttaccctccccacggagagagtaaagaacttcttcttcattggccaggagagcgtcggccccatctccatcctgatcttgctgacgattctcatcatcgttgccatgtactttgccaaagagcgttctacattcggaaggcatatggacgcgctgtgcggcaatgttagggcgtcgcttcttgcgggaatcaacgtgcgcaaggtatttgcggcaaccttcatcatcagttccctgctggcggcgctggcaggcgtcatgctggtatcccggtcgggaaatgcggtgccgcgcggcgtggagacgtatctgacggattgctttgtggcggtctacatcgggaccctggtgtcggccaggaataagttcaacatcatcggaagcgccatcggagcgttgttcgtaggcttcatcagcaactttattacattgatgggcatggggatcgcatataagaatatttttaacggcgtgtttattatcttagccgtggcactaggcgtattaaagagcaaggtaaattcataggagggatgacggatgctgaaagtagatgcacattcgcacgtaggaaaaggggccgcggtctggagcggccaggatgtagtgaaccggatggataccatgaaggtagacaagaccatcatatttccgtttacggaaggatactttaacaatgacgagatcatggattacgtgaatgaaaatccggaccggctgattccgttctgcgcggtaaatccttggaacgggcaggaggcgctggacgatctggagaactgcttccaaaaaggattcaaaggggtgaaactgcatcctacgctgtgcggttttccgctcagcaataagaaactggtgaacccgatcttcgagattgcccaggcctatgacgcggtggtgatcgtgcatggctcggcggatctctataactgtccgctggaattcgaccggatggccaggagattcccgaaggtaccgttgatcatggcgcattgcggcttcttctgggagtgggagcttgctatcgaggtagccatggagaatgacaacctgtacctggagacttccagagtaccgggattcgagaccagcaaagtgattcagaagttaggcggagacaaggtgatctggggaacggacgggccgttctgcgattatgaatgggagttcaacaagatccgccgctatgcgaaaaacgcggaggaatttgataagatcatgggaggaacggtgctgagtcttctgaggaaagagtaatacagattaaggaaaagatgaaacagccccttccctgcattttcagcgggggaggggcaagttagtatcctggccggcctgaaatctatggctggctttccagctttttaagcactttttctacaaatactttggcgtgttctacatccaggctgtcgggatgggtgatggcctcgtcgaaattatggatatacatgtccatctggccggcgttctggtcatttttcatggattcgtatttctggcgtaccttctggggcatcttgccctggcaaatgaaggagcccaggtaatcattgtccgtctcgatccaggcgctgacgctgttctcgatcgccttataatattccggcgcgtttcccattccgcaggtgccgaaaagagcgatctgcttgccgcttaagtcattgataaagtcgctgaccgccatgctgcaggttccccggtgcacgcagaatccgatgaaatagacctcggcttccgggataggcttatcggtggtaatgtcaatcaggtctttggagttgccgggaaggcgcgagaagatagtcgcggctattttcttggtgttaccggtctcgctctgataaagaactaaataatctaacatatcaatcatacctcgctttcttaagaggcagcgttcctgatcaggactgtctcatgattatatatatcctccgggggctccgccaccgcagcataggccgcttccgccgcagcacaggttgcatacgatgttggcgatgcacaacttcatgcaccagctgctcccgccggtaaatgtggtctggtaagggccttgctgctgctggtaccaggttccgccgctctcaaagcggtttaccagcatctgatactgtatgttgtccgggtccagacgaagcgcctctttggcgtgctggagggcaatcacattattgccaagccctgagttggcaagggcactgtaataataccactgggcattgcgcccggacatgccgtttaatagattcaatgcttcctgatagtgtccgctgttgataaagttggccgcggcacgcatatggaggtcctcttcattttccgtagggtttgggccagcctgctggtattggccccggaagccgcggaaggtgccgaagtcgccgaatcctccgaatccgccaaagtccccgaacgggccatagccgccggatgagccgtatccgccggaagtgccatagccgccggatgaatagctgctgtcggctgttccgtattcccgctcgtgcatgatctgcttgtatgcctgctggatttccttgaacttggcctccgcctggtccttattcggattgttgatgttggcgtccggatggtattttctgctcaggtttctgtatgccttttttatttcttcgtccgaggcgcttcttgggatgcctaagacgctgtagggatctatcataatttatactcctgtatctgaattgtcgcggtcagagtcggctgtgtcctttggactgctgctgccagaacctgtcacattctctgcgtcattgcagccagtatctgcgctttcactggattcctgccgcttggcggtaactgccgtatagcggcaccagacgccggaatataagacgtttcgcaggatctccgcatgcagaagaattggcagcttctcgaattccctggaacactctgccatcataagtgtcagcagtccccggcagtttccggcaaagtcgctgtcattagcgaacgcttctttcagaggattgtaacttcccgatgcgatatctttttctacatcttcataggcatccatcagatagatgaatttgcccaggaagaatccgatcttgcgaagagaggcctcccattcgtcgggctgccatgcaaagatctccgccataatattgccgaacagtccggccatcaggtcgatattctgctcattttcctgctccagagacgaaaggcgcttcagattagaagcgatgccggctaccttttccggatatctgccgcgaatggcttccactttcggcttcagcattcttgccgccatataccccttcctgctgcgctcgtcgtcccaatcatccttgcatttataataagtaaggacaaggttgacggcagcggcgtaatcggtaaaatgattggtccgcgcaacatgcttttcgaatggatgggctatgcagtttacgacctcccgctgggtctgcggctcgtagaggccggtgagaagtacgatgagaaatgtcatgtcaaaggataaagtcatctgacctcttataccataacattctttcagacatttgcaaagaccacaatagtacgaatggtacacatcatagtctttgaatttcatctcggctttattgattgcaatatatccaaacataagaattccccgctagctgttcttgatgaatgtggtattacatttgggacagcggatctctatacggccttttcctttcggcacgcggatcttctgccggcaggtaggacatttgtagatgtggtgcgtcttgcgctgggccatcatatttttctggcgggcgaagaagcagcggagcttgtaggtcttattcaaataccattggttctcggaggaacgcttgtagatgttccgggaaaacatgcggaaatatgcgtatataatgcagaaccaggctaccagggaaaggataaagctattcttccagcccgcgatcaacatgacgatcaagcctgcgatgatcgtgaatttccccagggaatccatcccatatcttccatacataaaacgaatcagtttttctttcaaaataatcaccttcctaatatatttacaatcatacgctatcgcgcccataagtcaataaactgccgattaaaaatatataaagtttttgaggctgcattcccatattttatataaatatgatataataccgacaggtattgcctgcgtgtgcgggtatgtttgccaggttcaggaaaggcagggagcatccatgagagaattaaccaggttgattaaagaagatatgaagccggcgcttggagtgacggagccgggggccattgcctatgcggtggcgagcgcaaaatcccatgtggacggcgaagtgaagaaggttcatgtggcattgaattccggcatgtataagaatgcatttacctgtggaattcccaattcgtcccggtttggcaatctgtatgccgcagcgcttggggcagtggcggccgactcggctaagggactggaatcgcttgcggatattacgccggaggatgataagaaggcttcaaagatggtggatgaccataaggtggaagtggtgctggatcatattggatccgagattacaatagatgcgacggtggagacggagacggactcctgcacggtacatatccgccatagccacaccaatattgtttcgatagaaaagaataacgagattatatatcaggcggatgcgggtcgtgcatctgaagcccaggcggaagatgaggtgcccgcgatccaccgctataccttgaaggaactccttcaatatgtcagggaggttccggtatccgagatagactttatccgggaggcattttccatgaatatggatctgctggaagaaggcatccagtcagaccggacaacgatcacacggcagcttctgaaggagaacgggcacaagattatctccgaggatgctaaaagcaccgcccagctgctgtgtaacggcgccatcgaggcacgggtgctgggacttagccgtccggccatgagtattaccggaagcggggctcatggaattattgcgacgatgccgctgtttgcctattatcaggtgaactacgaagtggtggatgacgacattcttcttcgggccgccgccttaagttacctgattaccatgtatatcaaggaatattccgggaaactgtccgcattctgcggatgcgggatcgcagcggggacagggatggcctgcgcgcttgcgttcatgaggaacgcggatgaggaagcgatcacgatggtgatccagaacatggcaagcggccttacgggcatgatctgcgacggcgggaaccatgggtgcaccatgaaaggaatcgtggcggtagacgcggcgtttcgtgcagcagatatggcgatggatggcgtatgcattgaggacatccatggaatcaacgggcgtaccccggaggataccatgaggaatatgggacttatcgcgtctccgggaatggtgcagacggaaaagacgatcgtggaaattatggaacagaagtaaacgagcgagagggttggcatgaaggaagacaagaagcacggaagcaataataatagaaataatagcagtagaaacaataacggcggtaataagagcggcagaaatagtagcagcgtagacagcatgagaaaagatgaaggccggggaagggacatccgggataaacggtatcatagaggaagaaagaaaaagaagaagaaagcagggattttctctacgatcatattggtagttgcgcttgccgtattctgcttttcggcgttccagctcttcaagatcctgaaggggtatcatgacggcagaagcgaatatgacaaagtccggaagcttgcggtggaagaaaagaagggcgatggggaagatcagttcagcgtcaattttgacgagttgatgaagatgaatccagataccatcgggtggataagattccatccggagccgtcccagatcagttatccgatcgtaaaaggaaaggataacagtgaatatttgaagaagacattttcggcaaatgagaatacccttggggcaatcttcctgaatgtcgataataatgcggactttatggacaagaataccatcatctacggacatcgcatgaaggatggctctatgttccggcatctgcaggattatgaagaaaagtctttctgggaaagcaatccatatttttatatctatacgccagatggcagggagattacgtatcatatttattcagcaggacaggtagaggatacttcagatacctatcttacgtcctttgagtcggaggaggcctaccagtcgttcctgaatatgacgaaagaagcgtccctgtatgatacaggggtggaactgaatgcacagagcgccatcgtgactctgtccacctgtaccagcgccagcgacaatcaccgcttcgtggtacggggagtaaaagaaaaagaggtgaatttgaaggagcaatgaaaaatgggtatatctatgaggtaggggacatcgtaaccatgaaaaaaccacacccttgcgggagcaaggactgggaaatcctaagggtcggagcggacttccggctgaaatgcacagggtgcgggcaccagattatgatcgcgcgcagactggtggaaaaaaatactaaggatttaaagaaaaagtcttgaaacaagcaccgaattatgctatcatattaactcgtgatacattaacatccgtaggctttagccagcggatatccttgctcccacacaagatgagcgggggccaaaagaccagaaggaggtgcaagacgacatgaacaaatatgaattagcagttgttgtcagtgcaaaaatcgaagatgacgagagagcacaggttatcgaaaaagttaaagcattagttgaacgtttcggtggcaagatctctgacgtcgatgaatggggtaagaagagattggcttacgaaattcagaagatgaaagaagcatattactatttcatccacttcgaatctgaagctgatgttccaggcgagatcgaacagagaatccgcattatggacaacgtgctcagatatttatgcgttagacaggaagcataagcaggaagtagaggtaattatatgaataaagtaattttgatgggacgcttgacaagagatcctgaagtaagatattcgcagggagataatccgatggcaattgccagatatacgctggctgttgaccgcagattcagacggggcaacgacggagaccagacagcagactttatcggatgcgtggcattcggaaaaagcggggaatttgcagagaagtattttcgccagggcctgaaggttatcgtaaccggacgtatccagacgggaagttatacgaacaaagacggacagaaggtatataccaccgatgtcgtagtcgaagaccaggaatttgcagaaagcaaggctgtaagcgatgctaacgcaggcggattccgtgcagcggctcccacaccggcaccagcaccagcatctgacgcaggtgacggcttcatgaatattccagatggaattgatgaagaattaccgtttaattaggttctgctaagtaaagcaaggcagaatctcatcagattatgaaaggagaattgtgcaatggcttacgataaaggaaatcgtccggaaggcggcttcaagagaagaggcggcggacgcagaagaaaaaaagtttgcgtattctgtggcaaagagaataacgagattgactacaaggatgtagcaaagttaagaaaatacatctctgaaagaggtaagattcttcctagaagaattaccggaaactgcgctaagcaccagagagcgcttactgtagcaatcaagagagcacgccacgttgctctgatgccatacgtacaggactaatgatagactgttactatgagagagtgttgaggatgtcccgacgagggacatcctttttgcgttgtatggcgtttgggtgtatgataatagggtaagataaaagcagctgtccgcgagccatggaagaaagcatactgccaccggtgaagaacttgacaggcaaaggatagcagctggatggcgaaatggctgaaaggtggtggatgcttctgaaggcgagactatttatgggagtaaaagtgtttgcagtgcttttgacagccttgtgcgcgggcgtttcgctggcgggctgtggccgcgtggattctgcgcagcctgactctgcgcattctgacttagtacgctctgattcggattacgctgaattggaagatgagaagatgcagggaaaggatttaaagaagactttggatgaggcggcccggcagtacctggaggaaaatcagaagagttatgaaagccgggaacaggttgagtttctatccgctgggaagaaaggcggggaaaacggcagtgactcggcggccattatcgtatcgagagttagcattgataaaggcgcaggagtcgttcgctatgagcagcaagaagagggcgaggagcaaaaggatctggttttctacacggaggatggatattattattttcaggctatggaggaaagtaccgtttggtatagaatgtcatcaaaggatgtggggataagctatgaggagatagcctgtctgccggatgcgctgtataaagatgatgccaatgtgaagtataagaagataaactaccggaaggatttggaagaaggcgacaaggaagaagataacgagaatcagaaaatcgaggtagaaggctcctatttataccaggataaaaacgtaaattttacggacatctggtggattaaaaaggcggaaggcaaccttgtaaaatgcgagtcgtggcgtacatttgattcgggccaggagtcgcatgcagtaatctctatacggatgggggaggattgtgaaaagatccaggatttcccggaaagttatctggagactacaaaagaagatttagagaatggagagtttggactatgaaactgacaatattaggaactggaaatgctgcggtatcggagtgctataatacctgtttcgttctatctgataaggaggaacattttcttgtggatgcgggaggcggtaacaggattctgaaattgctgaaggacgctggaattgaattgaaagatattcatgatattttcgttacccacgagcatattgaccatgtgctgggagtgatctggctgatccgcatgatcggacagcgcatgaaccagggcagatatgaaggggacctgagaatatactgccatcaggaattggcggaaaagattcagacgatcgccagtctgaccatccagaaaaaagtgtgcaagaatatgggagagagaatccagttcgatatagtggaatccggcgagcagcggcaaatcatgggatgttccgtaacctttttcgatattgcgtccacaaaagcaaaacaatttggatttactatgaaacttaaaaatggcgaaaaattcacctgcgtgggagatgagccttataacgaagtgaattacgaatatgtgaaaggcagcagctggcttttgcacgaggccttctgcctgtattcagaggcagataagttcaagccatatgaaaaacatcatagcaccgtaaaagaagcctgccagctggcagaagaactgggggttccgaatcttttactctatcacacggaagagacccatttgaaagagagaaaagaactctacacagcggaagggcgggagtattaccatggaaacctgtacgtcccggatgatatggaagagtttataatatgcacgtaacagttttcacatttacacgtaacaaaatgcaaaagtgttacgtgtccttcctgcacaactggtgtgtaaaatcgcaagaactcctgtgtaagaatgaaaaagtggtgtgttaaaaagaaaatagttaacgaaaaggcgatatatcaagaatcgaatgttaggattccagatatatcgcccttttagttgtcctttaatttttactaatacctagtaacgttttgtaacggataattttcaatttgacacgggggttagggcagttttacgcaccagttatgtagggtttacacgtaacacttttacattttgttacgtgtaaatgtgaaaactgttacgtgttacttttccccttttcccttttccaccgtatctcgcagggctccagggttactgtctcgcaattgccatcgccgtcgtagaattttgtggtctgtgtctcgttggagttattcagaatcgcgtatttgccgctttctggatatgcgttgacctcgcagttcaggttatctgcgaaccatacgtggaaggcgtcttctttgtgcgccgcatagtacatggctctcatgagaaggcgtgtgttcgcgtaactgtatggaagtccggagatgtatacgccgcggccttttccgtaggcgttggccgccatgtggacttcgttgttggagtattcgatgatctctgtgtctgcggacagggcgtagatatcgtgctttacttctccgaattcgcagcaagcggtgcggtcttcggtgatgaagtggctgtctagcgccttggtgaaatacttgtctgtggagagggtatagcccagttccttgtcaacacccaggatatcggacagctggaagaagcgcccgccgtggtgtacggcagttggctcccctacgccaataaagccgccgccttcgtatacccatttgcgaatggcggtaaccagtgtttcatccagccactcctccccgccggagaaagcagtgcctgcatcgccggcgttgatgatgacatccacgtcggcaggcacgccattttcgcggatatcgtcgaaactcaggaataccacgtcaacagcagcaccgcttaaggattccaggattccaaaataagagtaggtctgcttgtaccacagtgcatgagccaccatgtaggcctgccaggagcgcagtttcccccaggagttgaggatggctactttcagtccgcagtaaggctttttgccctttacgttgtcgtagatcaggcggaattcatccgttactttctcaatataatccacgaatttcgggaatttataagccaggcttaaatagccgccgtatccgattctgtctaccgggttgcgcatcagggcacgccttgcgctgagccagttgtcgatggcttcgatgcaggggtcgttgccctcgtagaaggtatccgggaagaaatatggaaggaagcgtccttctgtatatttcactcctggaatatcggagatgagacgcaaggtagcgccgccgcctacgcttccgactacggcgtcaagcccgatgctttcaaaatacggcccataaggctcggttccgatccagttgtctcccaggaacatcatagcctctctccccgcctcgtgggtgaggtcaaccagttcttttgcctttctggcaacgaatctctggatgaaatccatatactggcgataggctttggtgggcacgcggaaggtggagttgtaatagccgttgtccacgatatcctccggcctcagcgcatagccatactcctgctcgaattcttccagcgccttgatggatacggtagcgccatagccaaaccagtctacgaacttttccttccggccggcgccgaataccagcgtaaagtgatagaagaaggtggtaaatcgcacgacatcggtatccgggttgtcaatcagccactgcttcaagtagtctttggcaaatgccccggagtttgcctggcgtacatcaaaggggatgtcatgaggcttgtccccccagtcattggtgatgtggttatacatctgtgtaggatcccagatggcatatacgaagaaggacaccgtgtattcatggaacggcacagccttcccgatcgtgacaagatccttctcctggtcaacggaccagtcggatgccggtacgacatctcctgtggtacggtcgattacctcccaccatttcttcgggtcgtgtacatagtcggcaatcacctgctcgcggtaatacccgtccaggaaatcaatggtaacagaattggatgtcgcaagattgtgcttggacatcaggagcatctgctggcactcatccatgtgttctttcgcaaactcattgtgccccctggctacaaaataggttgtatatatctttgcatccaaagacttaatttcatcatcaagcttcgtgccgtcgctgtccctgagggcatcggcaccccaacggtcaagcatttcctttgtctcttccagaaaatttgactcgcttggcaaggttactcttccttttgtctttgacataattctcctccttttataaatatctatctctgagtatatgcaatactgcccaggatttcaatagcacgattgttgactttttttgtacttttgtgagttcacatttgcacaatcttgtttttgccagcgttttttggtatattataattagcggacagcgggcaaatggcagaagttaacaaaaataaaataaggaaaaggagttggcaagggtattgtctatgaaggtcgaggtaattaatagcgccaaggagttggaggagttatcaccgtttcatgtggagtgtcttctgtgggggacgaaggaaataccggctacatacggatacatgggatttgttccgggagatggcttctatatcaagatggtatgcgaggagaaggatcctctgcgtgcttatgaaaatgatttggatccggtatacagggacagcgcgatggaggcgtttttcatgtttgaatcagagaaagagaggagcggccttgcaacttatttgaattttgaagcgaatgccaatggggcgctgctggctgcatatggaaaagaccggacctaccggacttgctttaccaaagaggaattaaaaggctttgcgtgcgaggcgcagatactggaagaccggtggacgatccgttttcggatcggaatagatattctggagcggatatacggaccgcttcatctgcaggcaggcagcacttttacctgcaacttctataagatatccgaggcaaaggagatcgagcattatgcttcctattcgccgatcaagacgaccatcccaagcttccatctgccagaattctttgccatggcggagattgtcaagaggcagggccgttaactaaagaacaagtaaatcaatataaatatgtatgtcaaggaggatgtattatgagaatcatcaaagcagcagattatcaggatatgagcagaaaggcagcgaatcttatctctgcccaggttattatgaagccggattgcgtgctagggctggcaacaggctctacgcctatcggggcataccagcagctggtggaatggtgcaagaacggggatctggacttctcagccgtgaaatctgtgaatctggacgaatataagggacttccaagaaccaatgatcagagttactattattttatgcacgaaaatctgtttgacaaggtaaatatcgatccggctaatacacatcttccggatggcacagagccagacagcgataaggaatgcgcaagatatgaagcgctgatccagtctcttggcggggtagacctccagcttctgggacttggccacaacggccatatcggattcaatgagccggcagatgaatttgacaaagttacccactgcgtagatctgcaggagagcaccatcgaggcgaacaaaagattcttcgcttccgcggacgatgtgccgagacaggcatacaccatgggaatcggcacgatcatgcaggcaaagaagatcctggtggtagtgagcggggaagataaggctgacattgtggcaaaagccttctttggaccggttaccccacaggttcctgcatccatccttcagatgcatcaggatgttacgctggtggcggacgctgcggctttgtccaaagtgcctcaggaataaggagcgccggacccggaagaagggaaccggaataaaaggcgggatattgagatataagagcgaaaagaatggcagaggaaagtcagaagcttccctctgccattgctttaatggaagaagcgtattcggatggcgtcattccggtcaccttcttgaattgcctggaaaagtagtggatggacgtgtagcctaagtgctcggatatctgggtaaaattcatccgattggtccggatcatctcttttgcggcattgatcttaagaagagaaaaatattcgataatgcccaggttgcagtgctccttgaatatcttctggagctgggagcgtccgatcaggttgtcccggcagatctgctcaatggtcacgtgggaactcaggttgctctccaggtaatccacaacccggttgaaaatctccgtgtcactcttactcttggttgccttgggcggctcgatcttaggaagccgctttctcaccacgattggattggaatatcttcggatgaggtggatgaggaaatgctccaggtataagcggatcaactgctcggcaccgaacatatccgggtctttctgaggcatattctgaagataagggtcgtccaggcggcagtcaaagcatcgccttgcttctattataatgtctgccaggagatttcgttccgtctcatcaatacgcagaatccgcttcttgaagaaacgcatcgcctcgtcctcgcatttgaatgatatgaccacaagattgggcgcggtctctccggtagcctttacattgtggaattcatttggctggtggaatgccacgtcccctttcttaagcacggtaaatgtcttgcccgcggttaccccgacctctcctttgtctacacagatgaattcccagaaattgtgggattctccttcgaaggtgaagtcgctcatatattcaaagtagtgtatgctgtatatcttgcttacggatattgagttcctgagattgattccattatatcccatatctaaacctctcttttgtgaaatgtgtaaaaagtctgagaaattattttggtcattcttactaatataataccttattttttgtataaaatcaaaacaaaaatgcagatagtgcaaattaagaatattttcagataaagatttttgtgcacctttataatacaatggatacaagcaacaagataatctttataggaggtaaagtattatgaaaaagaaaattgtaagtgtgctgttgtgtgtagcgatggttgcaacaatggcagttggctgcggcggaaagaaaaccgacggagacagcggaagcagcaagggcggagacaagcttgtttactgggcaatgtggagcgaggatgagccacaggcaaaggtaatcaaagatgccatcgctaagtacacagaggacacaggcgtgaaggttgatgttcagttcaagggccgtaacggacagcgtgaaggacttcagccagcactggacgcaaagcagaacattgacttatttgacgaagatgttaaccgtgtaaacggaacatggggcaaatatctgatggatctggaagacatggcaaaagactatgaggcagagcacggcaacgagacactgtttaagattgcacgtaatgcatatggacagactcatgacggagatgacacattacatacgattccttatcagccatctatctttggattcttctacaacaagacattatttgataaagcaggcgtagaaggagttcctacaacatgggaagagatggatgcagcgtgcgcgaagttaaaagaagcaggaatcactcctatcacagctgatgatgcttatatgacatccttcatcggaatgcaccttgcaagatatatcggacaggacggcgtaaagtctcttgttacaggcgaggcatcaaacgatgtaacggttacatgggatgacccgaaggttcttgcagcagcagaaagttttgctgattttgcagataaaggctacttctctaagaacatcgcaacaaataaataccctgcaggacagaaccaggaattcgctcctggcgaagctgcaatcgtaatctgtggatcttggcttccgaacgaagcaaaagaatctgtagcagacgatcttgagtggggctacttcaactatccatcagttccagacggaacagatgacagcacagccaacaacattgcaaaccaggtatttgcaattaacaaagattctaagatggctgacgaagcattcgagctgattacttatatcactactggcgaatttgacaagaagatgacagaagaagctctttgcatcccgacagacaaggcaaattctgatgcttggccgacagaactggctggcgtgaaagaaggctttgatgcaactacaacatactatgactgggcagcaggcgttgaaagcaacaacgaccttacaccagtacttcagcagaatacgcttgaccttgcagcaggcaagattgatgcggcaggatttattaaagcaatgacaaaggctgctggacaataagaactagaaaagttatacttgtcaggtaagacaagtgcacaatatggtggcagggcggtacactacgctgccaccatattttatagagaggaaaaggagggcatagcaaatgaagaagaataagaaaatgataattggctttattgcgcctgcggttatcatcttcctcattgtattcttgtatcccattatcaggacaatcatgatgagtatgtataagattgagtctgtaacggataccatggaatattggacattcgtcggagtacagaactatcaaaagttatttacgacagcgattttcaagacagcaatgtttaatattttcaagatctgggccatcggcggagcaattgtattagcagtatccctgctgtttgcagtaatccttaccagtggaatccggggaaagaaaatatttcgtgcaattatatatctgccgaatatcgtcagcgcggttgcacttgcaaccatgtggctgcagtatgtatacagttccaagttcggcttgctaaagtcatttttggatgccatcggccttcataagttggctgatactccatggcttgacacgggccataagttctgggcattgctgtttgcctactgctttggcatgatcggatatcatatgctgatctggatgagcggaattgaaagaatcagcccggaactctacgaagcagcaaccattgacggcgcaaacaagccgcagcagttccgttttatgacacttcctctcttaaaaggcgtgtttaagaccaacattaccatgtggtcagtcagtgcggcggcattcttcgtatggtctcagctgttctccaccgttacggcggataaggccacgatcgtgccggtacagtacatgtacatgcacacgttcggggccggtaatgcggtgacagagagaaatgccggatacggcgcggcaattggaattattctgtgcttatgcgtcgtaattatatttacgatctgtaacaaactcatcaaagatgacgatcttgaattttagaaaggaggagcggttatggctaaggaaaaagaaaaaaaggttagagaaaagattaattggaaaaaagaatttaaactggctcccggatatatcgtcatcatcttatgggtaatatttacatttatgcttctgggatggatacttgcggcaagtctgtcaactacggcggatatctttgcaggcaaggcgctgaagttccctacggggctgcattttgagaattacgcgcaggcatggggctccggaggtgtcgctacgttcttcatgaactcattgctgtatgcgctggtatcatgcgtgctgctgatcctgatctgcgcacccgcggcatacgtgctgtcgagatttaccttccttggaaacaaggtgattcagaccagtttcgtgtctgcgatgggaattccgatcacaatgatcgtacttccgctgttcagtattgtggccaacatgggaattctgaataacatatttgccagcaaggttacgctgatcttcttatatataggaatcaacattccatataccacgatcttcctgctgacattcttctcaaacctgtcgcgtacatatgaggaggcggcagccatagacggatgtcctccgacgaagaccttctggaagatcatgttcccaatggcgcagtcaggccttgtaacggttacgatctttaacttcatcaatatatggaacgaatatttcctgtcattaatatttgcaaacaacgacgctctgcgtccggttgccgtaggactctacggaatgctccagtctatgcagtacacaggaaactgggcaggcatgttcgcggcagttatcatcgtattcctgccgacctttatcctgtacatcttcctgtcagagaagattatcggaggcgttaccggaggtatcaagggctagtcgtttgaacattacatacatatttataagcttggaggtagaacaatgaataagccagtattggttatcatggcggcaggaatgggaagccgctatggtggattaaagcagattgacccagtagactcagatggacacattatcatggacttttccatgtatgatgcgaagcaggcaggatttgaaaaagtaatctttatcatcaagaaagaaaatgaagcagacttcaaagaggctgtgggggaccgtatggcaaaatatatggacgtatcctacgcgtaccaggaacttgccagcattccgcaaggctatgaagttccggaaggcagagtgaagccatggggaacggcgcacgcagtcttaagctgcatctctttgattgacgggccgtttgcggtcatcaatgcagatgattattacgggcaggaagcatttaaattaatctatgattatctggcatcccaccaggatgacgacaagtaccgttacaccatggtgggctaccatcttggcaatacagtgacagacaatgggcatgttgcccgcggagtctgcgatatgaatgaaaagggcgaactgatcgcgatcaacgaaagaaccaggatcgagaagcgcgatggcggcattgcctttacggaagatgacggagagacgtggaactttgttccggcggatacgacggtatctatgaatatgtggggatttaccaagagtattctaaaagagatagaagagggattcccggcattccttgacaaggggcttaaggagaatccgatgaagtgcgagtacttcctgccgacggttgtcagcaatcttctgggtgaggaccgggcaaccgttgcagtcctcaagtctgcggataaatggtatggagtgacttataaagaggataagccggtggtagtggaagccatccagaagatgaaagatgagggacgctatccccagcatctttgggaggaagcataatggaacacgtgacacagaagcaaagagacgaagtgatcgcgcactttaagtatgagggaatacttatagatgagcgtccttacggaagcggccatatcaatgatacatttctgctgacttttgagattgcggagatgggccagctgaaggtgatcttacagagaatgaataaggaggtattctccaatccggtagaactgatggagaatatcatgggagtcacctcttaccttagggagcggatcattgaaaatggcggcgacccggagagagagaccctcaatgtcattcctacggtggatgataagccttattacctggattcctatggcgactattggcgttcttacaagtttattacggatgccaccagttatgaccaggtggagaatccggagcatttctatcagagtgccgttgcatttggcaatttccagagactgctggcagactatcctgccgatacgcttcatgagacgatcgtaggattccatgacacgaaagcgcgatttgccacattcaagaaggtggtagcggaggatgtcatgggaagggcagcgtctgtacagaaggagatccagttcgtgctggatcgggaggacatcgcggattatttctctgaccttcaggccagtggagagattccgcttagggttacccacaatgacacaaaacttaacaatattatgattgataataagacggggaaaggaatctgcgtgatcgaccttgatacggtcatgccggggcttgccatgaacgattttggggattcgatcaggtttggcgccagcacggccgcggaagacgagcaggatctggataaagtatcctgcagtatggatctgtttgacctgtatgcaaagggctttatcgaaggctgcgccggaaaactgacgaagaaagagatagacctgatgcccatgggagccaagacgatgacgttcgagtgcggaatgagattcctgaccgactatctccagggggacgtttacttcaagattcacagggagggacacaatcttgacaggtgcaggacgcagttcaagcttgttgaagacatggagaaaaagtggtatactatgcaggacatcgttaagaagtatagtaacagctaggaggtagaagaatggcgaaaatattgattacaggcggagcaggctatataggaagccatactgcgctggaactgctggaagagggctacgaagttgtcatctatgacaatctttccaattcttccagggaatcagtcaagagagtagaagaactgacaggcaagtccctgaagttctatgaaggcgatgtattggacgcagacgcgctggaagcaatgtttcaggcagagggtatcgatgctgtcatccattgcgcggcgctgaaagcagttggggaatctgtacagaagccattggaatactaccataacaatataaccggaacattgactttgatgggcgtgatggacaaagtgggcgtgaagaacatcgtatttagttcttctgccacggtatacggaagccctgagattattccgatcacagaagagtgtccgaagggacagtgcaccaatccatacggatggactaagtccatgatggagcagatcatgacggaccttcagaaggctcatccagaatggaacgtcatcctgctgcggtacttcaacccggtaggcgcgcataagagcgggcgcatcggagaggatccaaagggaatcccgaataatctgatgccttatatctcccaggttgcggttggcaagctggagaggctgggcgtattcggcgatgactatgacacgccggatggaacgggcgtgcgtgactatatccatgtagtggatctggcgcgcggccatgtaaaagccatcaactatatctttaccaatccggggcttgatatcatcaatctgggaaccggcgttggctattccgtccttgatatggtaagggcattcgccaaagcctgcggcaaggagatcccttatgagatcaagccgagaagagaaggcgatatcgccatgtgctatgcagaccctgcaaaggcggcgagagtcctgggctggaaggcagagcggggattagaagagatgtgcgaggatacctggagatggcagtcccagaatccaaacggctacaaagattaagagaaatgatgcagcagacaggaatgtcttcggaatggaagagattcctgtcttttattttgcgcgaagaagtggtataatatttgcgtacattgtgttttgtgaaatgggaactttattaattttgaggatgaagttatgtcagaaaagcaaaaagagaatggaaaagtgcatttgaaaggacaattaagactgtacatgcagtggcccgcggtcatggcgcttctgcttgtggctatgaatatctggatctaccggatcgatcgtcgcgctggatccctgatgttcgtatttgtcctgatttatattatgatggtgggcgttctgtatctgtatagcaagtccattattatgaaagatttggtagagttcgccgcccagtatgggatcgtgcagaatacgctactcaaggagctggccgtaccctatgccattctgctggatgacgggaaagccatctggatgaataaccagtttcaggagatactgggaggaaagcccaagggagaatcttacatcagcaagtatataccggaattgaataaaagcatctttccaaaagaagtaaatgatacggtagagatggatgtctattacgaggatcgggagtataaggcggaacttcgcagggtatctgtggagggattcagcgatatggaacagctgctggagatgccgatggagaaggaatactttatcgccgtatacttaagggatgtgacggaactgaaccgttatatcaagcaggcggaagagcagcggctgattgcgggactgatctatatcgataactatgatgaggtcatgagcagcgtggaagaggtgcgccagtctcttctggtggctttggtggaccggaagatcaaccagtatatcgccaaggtggacggcatcgttaagaagatggagaatgataagtacttcatcgtctttaagaagcagtattttaagcagctggaggaggataagttctctctgcttgaggacgtaaaatccgtcaatatcggaaatggaattccggcaacgctgagtattggccttggcctaagctgcgacgcctatgcccagagttataactatgcccgtgtggcgatcgatctggcgctggcaagaggcggagatcaggcagtcattaaggatggaaagggcattacctattatggaggaaagcgcgagcagacttccaagaatacccgcgtgaaagcccgtgtaaaggcagaagccctgcgggagttcatcacggtcaaggataagatcttcgtgatgggccataagcttacggatgtggacgcactgggagctgccatcggaatctaccgggcggcggcgtctctggaaaagaaggcttacatcgtcatcaatgaggtgtccgcgtccctgcgccctctgtatgaaagtttcgtgcgggatccgtcctatccggacgatctgttcctcaactcgtcccaggccattgatctggcagacgagaattctatggtggtggtggtagacacgaaccgccctcagatgacggagtgcgaggaacttttgaagaagtctaagacgatcgtggtactggatcatcacaggcagagcagcgacaacatcgacaatgcgctgctgtcttacatcgagccgtacgcgtcctcggcctgcgagatggtatcagaggtactgcagtatatcgtggatgatattaagattccaaagattgaggcgagtagcctttatgccggtatcatgatcgataccaataatttcgtgaaccgtacaggcgtgcggacattcgaggcggcagcgttcctgcgccgctgcggagcggatatcacgctggttcgaaagatgttcagggatgatatggagtcttaccgtgccaaggccgagattatcagcagcgcggaagtttatcttgagaagttcgctatcgcaagaggcgagaatcttcatatagaaagccctacgatcataggggcccaggcggccaatgaattgctggatattaatgaagtcaaggcaagttttgtgctgacggagtacaatgggaagatttatatcagtgcccgctctatcgacgaggtgaatgtccagatcattatggagcggctcggaggcggaggccatatgaacgcgtctggcgcgcagttcaatcatacggatatggaggaagccgtggcatctttgaaacaagtaatcaatgatatgacagaaggaggagacatctaggatgaaagtaatattgacagaagacgtaaaatcccttggaaagaagggtgaaatcgtagaggtaagcgacggttacgcaagaaactttattttaaagaagaaaaagggcctggaagccaattccaagaatctgaatgacctgaagcttaagaaggctaacgaagacaggattgcccaggagcagtatgaagcggcaaaggaattgggaaaagagattgaggcaggaaagattgaagtatccatcaagacgggagaaggaggcaaggcatttggctctgtatcttccaaggaaatcgccgcggaggttaagtcacagatggatcttgatatcgacaagaaaaaaatacagctgaaagagccaatcaagacgctgggaacccatacggtatccataaggctgcacccgaaagttacggcagaccttaaggtggtcgtgacggaagaggcttaggaggagacttagcatggaagaggcgctcattaaaagagtaatgccacacagcgtagaggcggagcagtccgtcgtaggcgcgatgctgatggataaggatgcgattactacggcgtctgagattatctccggcaacgacttttatcagagtgcctatggaattatctttgattccatggtggaactattcaatgaaagcaagccggtggacttgatcacgctgcaggagaggctgaaggagaaggacgtcccggcagaagtcgccagcctggaattcgtcaaggatctggtgactgccgtgcctacatcggcgaatgtaaagtactatgcgcagatcgtggcggacaagtccatgatgcgcaagctgatcaagttaaatgaagaaatcgcgaatacctgctatgcgggaaaggaatccctggaggcagtgcttgagaagacagaaaaagcagtgttcgatctgctgcagaagcgtaacacaggcgaatatgttcccatcaagcaagtcgtgctcaatgccctggacaggatcgagaaggcatccaagaataagggaacggttaccggaatccctaccgggttcatcgacctggactacaagctctcggggctgcagccctcagatctggttctggtggcagccaggccgtctatgggaaagaccgcgtttgtccttaacatcgcccagtatatggcgtttaagaaggataaaggcgtcgcgatcttcagtcttgagatgtcgaaggaacagctggtgaatcgtctgttctccctggaatcccaggtagatgcccaggccttaaggaccggcaatatgaaggattcagactgggagaagctgatagaaggggcaggaatcatcggcaaatccaacctgatcatcgatgacacgccgggcatctcggtgtccgaactgcggtccaagtgcaggaagtataagctggagcacgggctggatattgtcatcatcgactacctgcagttgatgacgggtagcgtgggcaagaattccgagtccaggcagcaggagatctcagagatctcccgttctctaaaaggactggcgagagagttgaatgtaccggtggtagcgctgtcccagcttagccgtgcggtggagtccaggccggataagcggcccatgctgtcagacttgagagagtcgggggccatcgagcaggacgccgacgtagttatgtttatatacagggacgagtattataataaagattcagaatttaagaagcaggcggagattatcattgcaaaacaaagaaacggccctgtagggaccgttaatctggcttggcttggcgaatacacgaagtttgccaacctaagcaggcaagaataatttcttcagtttttccactgggccggttcccgctgcagacttccgaaaggattgctgctgacggatgagctggtccagttttctgaattcctcctcctcttgacgttctttggcgtccagaaggaaggacatttctttgctgatcatggacagcaggacttcattgttgttctcgagcatccgcttgatatgtaattgctcccttgtcctgcggatatccggaatcagcgcctttaattcggagaaaggcactccttgctcgtacagttccttgatgcagctgtaaagcttggcatcatcttttgtctccctctttaattgttctaatgcattgctacccatagtctatacccccttatcacaacttgtccttctgggtttctatatcatagcatggacgcaggagaagaatccgtcataacccgtcgaggataacggatatctttaaattcttaaggacaaaaaccgctaagataaggacgattttttggcaaaaaaaagaattgcatgtccacaattgtgacatgcaatgtctcttttaaaatgttattcgcatatctgactagccctgagagattgctcctgtaggacactgagcagcgcaagcgccacagtcaacacaagcgtcagcatcgatctcgaaatgatctgctccctgagagattgctccaactggacattctgcctcgcaagctccacagcttacgcactcatcactaattacgtgtgccataatatgtaccctccttttgattatatagatagacataaaccaaatttagtctatccatatcataatacaaacggtcaaaatatacaaggggtgacgcgccatttttaatattagtacattctgcccggtccccgcctgcaggccaaaaaaaattccggtaaaaattaagaaaaatttcaacaattattcaccgttttggtgtatagtgtaatttgttgaatgtgaatattagaatatgggagagaatgcataatgaaaaagagaagtagtatcatagccattttattgtgtgcagcgatgcttacatgtgcatgcgcggctcgcagtgacgataaaatagaggagcctgtacaggcagagaagcagaaagtaaaagtgaaggaataccaggggaagctggatatcatagagccgggcgcatataataacgtgaacggcctgaatctggagcccggctcctatatctccgtgatcggcaaggctgacggcggacagttctgggacgaagtgaaaaagggcgtggaccaggcggcgaaggatatcaatgaatatctggggtacgagggcaaagacaaggtgaaagtgacctatagcggcccggcagcggcagataatgtggatgagcaggtcaatatcctggatgaggaactggcgagatatccggtggctcttggcatatccatggcagatgccaaggcgtgcgaggtacagtttgaccttgcggcggagagcgatatcccgatcgtggcttttgattccgggagcgactaccagggacttatggccacagtcgccaccgacaatacggcggcatctaaggaagcggcatccaggcttgcggagattatgaaggaaaccggaaaagtcatcatctttgcccacgattcaaaatccaaggccgcgattgaccgggagaatgcatttaaggaagagatgcagcagaaccatccaggcattaccattggcgacgtctaccatctggaccagctggcagatctgcagaaaaaggtggcagaagagatcaacgcaggaacctacaagaaaggcggcgaggctacaggcgtgaagctggaagagcaggatgaagtcacgccggacagcattacggaagacgatgtggttgattacgtgctggctaagaatccagatgcgaagggctgctttgctaccaacagcgatgcgatgaaagtggcgcttaatggcttgaaccgcatggaagaggaagatatcgcgcccgtgggatttgacgcggataaagaagaactaaaggctctctcagatggggagattgacggcctgatcgtccagaatccatttggcatgggctatgcgaccgtcatagcagccgcaagggcagccctgaaaatggggaacgaagcggttgtggacacaggttatacctgggtgacgaagaagaacctgaaagatgagaatgtagcgaagatgctgtattaggttgattatggcgatataaagagtaagcaagttggaagcggacggcacggggaggcgttccgggcagcggggcggacgacttgctttgccgggaaagtataagtgaaaaaggcctggttttaaggagaccggacatattcggcgtgaaatcctgaaaggatttcgcacctcagatgtcctttcggattttgtttgagacaaaatcctcacaccttaaaaccaggcctttttcactaacactttccatacggctcgcgcgacgcccgcccactgcctggaatgcctccccgcgcctgacatctttttatgccgtggattttatatcagcgggagaaatctagaagaagtgcggccggaaggaggataacttcctgcgtaaggtgtacataaacgcgatcactccacccagggattgccagtagattgccgggagcgcatagcgtgtggggcgggaggcgcaggttaagtggaggcaaccggaggatccatccgcaaactgttagagcctgggacaggaggccatatgccgactgtcccagactcttacagtttgcgagattagccgcaggcgccgaaacgtcggagcatcccgcccccacaccctatgcgcggtgccaatccacgaaattccacacatcaagccttcggcagcgagaatataaactctgtccccacgccttccgtgctcacgacattgatattttccccatgggcctgtatggcttctttgacgatggccagtcccagcccggttccctttttgtccttgccccgggagaggtcggtcttgtagaaacgttcccagatcttattcagcgcgtttcttgggattccgatgccgtaatccttgacggaggtatagatcttgtcgccccgctccgtggtctcgatggtgacggtggaatccgtctcgctgaatttgatggcattgtccagcaggttgtagaggacttgctggatcttgcgcttgtcggcagtcacgtttaagtacttggtggcaaatagtaattctatggatattttcttctgcgtgcaggtgccttcgaaggcagcggccacgttcttgatcatctcatgaatatcaaaaacttccttggtcagaagaatatttttcgtatcaaattcgttcagggtcaggagatcctgggtcaggtctgtcagccgctctgtctcaaagaggatgatcttcaggtatttttcatgcatttccggcggtatggttccgtccgtcatggcttctacataccccttgatggaagtgaggggagagcggaagtcatgggatacgttggctacaaacttcttctggtagtcttccatatctttcaactgggaggacatgtagtttaaagaggcagacaggtagcccatctcgtcctccgtatctacggggatctcgtaatccagattgcctgtggcatactgggtagcagcctccgtaatcttgcgcaggggccggtatacgaagaactggaatcccagaaggatgataaaggacagcaggaagatgacgatcagcgttatgtaggctgcctgcatgagaatcttctgaacatcttccaagtcggatacatacttgtggatcagcagatagccgttgggggaatagccgtatacgacaggcgcaacgacggtgatgacgtcttccttgaacatatcgtgataagtgcctatctggtactgggagcctccgccctctgccgggtcaaagtcctcgatgacggcaggggagagaggataggtctctgactgggcagaactaataacctctccgttgcgatccacgaaccagacggatgcgcctaactgggactcgattcctgtcaactgcagatggacgtcggaggcggttatctggccggtaaaatatttgggcagataatccgcggccaccaggctggcctcccggtacatgctggaagagacattttcctttaacgggccgctcgtcagtccggccgtcagcgtggcaacggtaaagaggctgagaaagccgaatatgatatacatgatgatgaattttagatataaagtgctgcgcatgaaggttcctctttatctatttgacttcaaatttataaccaatgccccagacggtgctcaggctccagtcgctgtgatccttgatcttctcccggagacgtttgatatgtacgtccaccgtacgcgtatccccgatgtattcatagccccagatctgatccagaagctgttccctggtaaagacctggttgggggaggcggcaaggaaatacagcagttccagttcctttggcggcatatctaccgttactccgtccacgatgacagagtagttggtaagattgatggtgattcccggatattccacgcatttccccttatcctcgcccggaatctccggcttcgggattgcctggtagcggcgaaggaccgccttcaccctggctaccagttccttggaatcaaaaggcttcatcatatagtcgtcagcccccagttccagtcccagcaccttgtcaaaaacctctcctttggcggaaagcatgatgataggcacattggacttggcccggatctcccggcatacctgatagccgtcgatgcccggaagcatcaggtccagaagaatcaggttgggctggtaagtgtcgtaggcaatcaaagccttttccccgtcgtggaccatcatcgtatcaaaacattccttggtaagatacaatgagatgagctcggcaatgttctcgtcgtcgtccacaattaatattttctgcttatttaccatgttgctcctccttataaatgtcctctatattaatctactttagttctacaatggtcacgccggcatcgccttccccaaatacgcccagccggaaggacttgacgtgcttctgccgtttgagatagctgtggattccggatcggagggcgccggtgcccttgccgtgaaccacgcggaccgtggacaggtgcgcaaggcttgcgtcatccagatatttatccagttctgctacggcttcatccaccgtcttgcccagaagattgatctcagggcttacggagaaggatttgcccatctttaacttgccttttcccgtcttttgcatctgtttggcagtgtaggaaggtttctcctcaataatctccaagtcagaaatatggacctgggaacgcaggatgcccatctggacggttacatttcctttagaatccgggagggaagtaacagatcccgtcagattcatgcttaagaccttgacggattcgccaagcttgaagtcgccgggcttatgctgcttgcgcggcttctggggctccatcttcatgccggaacgggctgcgtccatcttcttgcggagacgttcccgctccttctccatctctgctgcggaaatactttccttgccaaacttgcggaaattgcgcatggtctcgtcggccgtctctttggcgtccgcaagaatagagtgtgccttttcgttggcctcccgcagaatccgttcgcgctgggcttccagcttctcctgcttttccttggtctcggccttgagccgttccagttcccggcggtatgcggcgatctcttcctgctctttctggatcgtccgcttgctggtctcaagatccgtcagcagatcctcaaaggattcatcctgctccgtcagatgggtcctggcctcctcgatgatatagtcaggcagccctaacttgcctgcgatggcaaatgcattactcttgccgggaatgccgatcaacagatggtaggtgggccgcagggtctccaggtcaaactcgcagcaggcgttttccacgccaggagtggacagggcgtagaccttcaactcgctgtagtgggtggttgccatcgtgcggatacctctcccatgcagatggttcaatatggcgatggcaagagcggcgccctcggtagggtcggttcctgcacccagttcgtcaaacagaaccagagagcgctcatccacctgctttaagaaggagacgatattggtcatatgggaagagaaggtactgaggctctgctcgatactctgctcatccccgatatctgcataaacgtcatggaatacggccagttcggagcggtccagcgcagggatgtgaagccccgcctggcccatcagcgtaaagaggccaaccgtctttaaagagacggtcttgccgccggtgttggggccggtgatgatcagaagatcaaaggcgtcacccagcatgacggtgatcggaaccaccttcttcttatccagaaggggatggcgtccctcgcggatatagatgcgcccgtccgtgttaaagaggggcatggaggcattcatatccagcgcaaggattccccgcgcgaagataaagtctaattccgtaagaacggagtaatccgtccggatcgcatcaatatattcagccacgtccacgctgagacgtgccaggattacctggatctcttcctgctccttgccgtagagttccttcaagtcattgtttaacttgaccacggacatcggctcgataaaaagcgtagagccggtggaggactggtcgtggatcagtccctggacctggcttcggtactccgcctttaccgggatgcaatagcggtcgccgcgcatggtaatgatgggatcctgcagatacgtgcgcaaagacccgtttaccagcccggatagggtggcgtgcaccttgtcgttgatctggcccatggaacggcggatgtgcttaagcgccgggcttgcgtcgtcgctgatctcatcctcttccaggatgcaccgccggatctcggcggacaaaggagccactggctccagctgctggaacagcgcatccaggcagtcctcggactcatcgctggtctcgtgccttccataagatttgacgcgtcccgcggtttccagcaatttgcagatgcggagcaattcgccgcttccaagagcggcgcccacctccagacgcttcagagagtctcccaccggattgcatccactaaaagaaggcctgcccttcttgacgatccgcgtaaatgcggcggcggtttcctcctgggcagactgaatgtctggtaaagatatcataggctttaacttccggcagcgttctttgccgctgaaggaagaagcctgttctgttaagagttcaattattttgttgtattcaagttttgtcaatgtttttttattcatgttattcacctagacttattctaccctatttgccccataaagaaaaggataaatattgaacatttgagcgccataaggtatactatagaaaggattgtaaaggagaaggatgcgtctatggaagagcataaagatccaggagaagaaataaatcgggaagaagaaaaagagcaggagtattcctttctgcaggaaacgattaaagatgagacaatcagcaagaaaaaagtaaaaaaagatatcttccggatggccggactaggcctggtatttggtctggtagccagccttagtttcagtgcgttcaagccatggatggacgagttatttcaaagcaatccgcagaaagtcacgattcccgaagaggaagaggaagaagacgaagccacgccggaagacgagccggaagcgacccagcaggttctggacgcagaaagctataggcagatgcagcagtctctgacatcggtggcctccgaggccaacaaatcggtggtggagatcgccggaaccacgggcgatcaggactggatgaccgattcctatgaccataagaacagcacggcagggctgatcattgcagacaatgggcaggaactgctggtatttggcaagacttctattataaaggaagcaggcgatgttcatattatattttcagacgggcacagttataaggctaacctgaagaaaaaagacggcaccctggactttggaatctacgcggtaagccggggggatatccaagatacgacctggtcccagatcaaggcggcaacccttggcagttccaactccgtgtccaaaggcgacccggccatcgtgctaggaagcccgtttggatatgcgggcgcagtaggatttggaacggtggcctccagcaagaattcggcagagttcgcagacggacaataccggctgatctgtacggacattgcaggggcaaggaacggaagcggcgtcatcgtgaatctgaaaggcgagattatcggcatcatagaccagagcatttccgaggaagacagcatgaacctggtgaccgggttcggcatctcggacatcaaagagatgatgcagtttttgctaaatggacagggcgtcccttacattggaatccggggcgtggatgtcacccaggagatcgaggcccagggtattcccaagggcgtctatgtgaaggaagtggagactgattctccggctatggcggccggaatccagtgcggcgatatcattacgaatatcaatggcacggatgtggctacggtggcgacataccacgccgcgcttatggacttggaatcaggcaagaagattaagatcagagggcatcgccaaggcgcaggcggctatgtggatatagacttcggcgtgacgatcggcagcaaagaataagataagttagaaagaggcaaacatatgaggtacatcaacaccctctgcgagggagagactattaagaacgtatacctgtgcaaagggaaacgttctgctgaaacgaggaatggaaagccatacgacaatctgatcctgcaggataagacagggacgctggacggcaaagtctgggaccccaattccagcggaatcgcagattacgacgagatggattttatagaagtatatggagaagtgatcagttataacaacaatctccagctcaatatcaagcagatccgcaaggcgcaggaagacgagtatgtggcagcggactacatgcccaccagcgagaaaagcacggagggaatgtaccgggaactgcttggctatgtaagccagattgaaaatacctatctgcgtcaggcagtagagtattatttcgtaaataatgagacgttcatcaagacattcaagggacactccgcggcaaagaccgtgcatcacgggtttgcgggaggactgctggagcatacgctgagcgtggtaaagttctgcgaatacatggtaggcgcttatccgattctcaataaagacctgctgtatgcgtcagcgatctgtcatgatattggaaagaccaaggaactgtccaccttcccggaaaatgactatacggacgacggccagcttctgggccacatcatcatcggcgtggaaatgatgagcgacgcgattcgcaccatccccggatttccggagaagttggcgagcgagttgaagcactgcatcgtggcccatcacggcgaactagaatacggttctccgaaaaaaccggcccttgcggaggcattggccctgaacttcgcggactgcacagacgcgaagatgcagaccctgacggagatcttcaaagacaagaataccaatgactggctgggctacaaccgcctgttcgagtcaaacctgaggaagacgagtatataaaaagggacgtaacactttttaaaaggggacgtaacatttttcaaaagtgttacgtccccaattgcaattagccctgtccccaattgatgaaatggagtatatttatgcagaaaaatgaattggttacggttacgatcgaagatataggaattaacggtgaaggcatcggaaaggtggatggttacacactgttcattaaagacgccatcatcggcgacgtggtggaggctaaagtgatgaaggtcaagaagaactacggctatgcaaggatgatgaatattcttacgccatctccataccgggtaaaacagccgaaatgcccgatggcccgcaaatgcggcggctgccagatccaggagatggagtacgaccgccagctggccttcaaagaagacaagatccggggaaaccttatgcgtatcggagaagtgccggcagaagtgctggatcaggcgatggagccgatcgtaggcatggacaacccatttcactaccgaaacaaggcgcaatttcccatcggaacggacaaagagggacacatcataaccggattctacgccggaaggacccacagcatcatccccaataccgattgcgcattaggtgtggaagtaaacgaaataatcctgaagcagatccttgcatttatggaagagtataagatcagcgcttatgatgagacagagcataaaggcctggtgcgccatgtgctgatccggtacggattcgtcacgaaagagatcatggtctgccttgtgatcaacggaaatcatctgccccatggggatatcctggcagagcgcctggcaaaaatcgaaggaatgaccagcattacgctgagcatcaacaaagaaaagacgaatgttatcatgggcagccagatcgagcctctgtgggggaagacctacattacagactatataggaaatgtaaagtatcagatctcgccactgtccttttaccaggtaaatccagtccagacggagaaactatatggactggcgcttgagtacgccggacttaccgacaaagagacggtctgggacctctactgcggcatcggaaccatatccctgttcctggcgcagaaggccaaggaagtctatggcgtggagatcgtgccccaggctatcgaggacgccaggaataacgcgaaaatcaatgggatcgagaatgtccggttctatgtgggcaaggcagaagaagtgctgccggagtattatgcgcagtatgagaaagagcatgggaggaaggcccacgcagacgtgatcgtggtggacccgccgaggaaaggatgcgaggaatcgctgcttcagaccatggtggacatggagccggagcggatcgtgtatgtgagctgcgactcggcgaccctggctcgggatgtgaagttcctgagggagaaagggtatgagttggttagggggagaggcgtggatcagtttgggcatacggtgcatgtggagaccgcctgcctgctgtcacgtaaaccccgctaaatcaaagggtttcagcgattccgggctgatagaggcgtgtgtttttctgtttggatgaactgaaatttgtttggtgttacccaggtggggtaagaaaaatgaacgttttggcaaaaggttagaaatttgtcgaagtgtgtaagacaatatgggatttgtattatacttaagaaacgtatcaaggaggggatactatgattccagagacttctgtgaattggaaggcatttgaatatatatattcagataatccgcaaagggcatttgaaaatcttacttattatttgttctgccatgaattcaatcagaaaaatggtatttttcgttactttaatcagccacatattgaaacaaatccgattcggctggacgataagcttattggttttcaatctaaatattacgcagacagtgttaccatgtctggtaaagaaagtgaactgatagaagctgtaaagggagctgcaaaggcgtactctggtattacgacactttatttttacattagccatgagttttctcctagttcaaagaaagatatcgtaaaaccttcatatcaggtaagcatcgaaaacgtagcccaaaatctcggcatagaaattgagtggcgtggaatcagtaatattgaagcacaactcatgcaggatagccagcttactgtttgcaggaatgtattttttcaggttgattccgcagtgcagaagtgttgtgaaagccttgatagacataaaaatgatatattcgatcgaattagtacaaatgtaatgtataaagggaataagattgtgttagatcataatgcactaaatcttgatatttttctaaattcaagcgaccagattttaattgtgtatggagatgcaggttctggaaaatctgcattgattaaacaagcggtgactcatcttagtgatggaacggcattccttgcttttaagagtactgatatggacgtagatgacaaactgaagtttttaaatttacatgggacattggtgatagatgaagtgcttgatgtatataaagaagcagataaccgtattttatatattgatgctgtcgagaagtattttgttcttgaatatcagcagacatttgaagacattcttcaggtctttatgaatgcaggatggaaactggttctcacaattagaacagcttacaaagaatcattccataatcttttgttaaatgaggctaaagttcaacagtatcatgtggattcgcttaactatgacaaactttcagagttgtccatcacatatggttttaggattccaagagataaaaagctcacagatattctttgtgcaccattctacctcggtttgtatcttgctcttgataacttagaagatgaagaaatgcttgctttaaatagggaagcttttgaaaaaaaaatatgggaagatattatacgcaacaacagaaaacgtaaaaataatatgccaaccagaagagaagatgctcttacgtctattacaagggaaatgctccagagtgagagttatctgtatgttatacaagcaacagacgatcatgaagctctttctgaattggaacagagcggtgtgctaactcagacggatgacgctagaaaatattgtcacagtcatgacgtgtttgaagaattggttgtaagccatatcttcatggaacaatataagaataatattgagggaaatcagttttttgcgcagtttcgaacatcgctacgtattagaaagttgttccgtggctggttatcagattttgctagcataaaaggacatcaggatattatctttaggattcttgatggcaaggatgtcaataggatatggaaggatgaggtgctgctaacaattatcagtacagaaaatttgaaggatgtttattgtaagattgcaacaaacatggctgataataactgcgagatgttaaagaaaattgtttttttgattaacacatgctgtcgtgtagcagatcatacagatatatatttaaatagaggaaatctattgccatttagactttcgaagccatctggatatgcttgggaagcgttatttgagtttatagtcgataataaagaatctatctattgggataagaaacttgtttctgttattattgatgttctggattcatggacaaaacattctgagaatgctaaaacggagaatactagaattgcaggagaaattggattattcttattaaaaaaaatatcggatgatgaagatttgcgatatgctgtaagggatgaacaggttaaaaagctacaggaagtattgcttaattctgcatggatgattagggaccatcttagtaatatattccaaattgtaatagatgggataaacgacggggaaaaggatatttcttttccttttactatgaaaaataacagaccaaatgcgccgagaatgtatgttgacttggcggaacgtgctgtatcggacatttaccattatggtaatgtaccatatgctatgcctgaaatggtaatcaggttgatgaaaaaattgtggcttagaccagtcggtataccaatttatgacagcttagacatggatggctacttcgggattaattcacatctttcgaataattatcatccggcgagcgcttataaaacaccaattttgaatatgctgcaaggtaatcagaaattgtctactgactttttgattagtttttttaatgcgacaggtgatgcttatgttaattcgcatttaaatgcggattatagtgaatgctttaaagtcattattcatgtagaaaatcagaaaatagaacaggttgcatcagatcgtctttggaaaatgtatagagggacacatgttggtccagatatacttgttagcctattgatgggatttgaaacatggctttttagtgtagtaaagaattctgcagctagtgtagttactgattattgtcgatatgtgctgaagggttctcaaaacgtaatgttaacttcgattattgttagcattgcggaagcatatccggagaaaatgtttgatgttgtctgtgatcttctcaaaacaaaggaagtttttcatcttgattcagacagacttgcatcagaatggtcagcgtcatttttgttattcggaaataatttgtttgaaaaggagagattggaaagtaacaagcttccccataggagtaaaagattagaagatgttattctcggatatcagacaaatacgaatggaattcctgaggaagactttaatttgcaaagacaaagggtatatagtgctattgatgatgcaacagtagatatagatacatggttaacaccagataaatatgcatattatagaatggatctccgacattatcaagaagtggttgatgttaattcagatggtgagggacatgaaatctatacggtaatacctgattttactgaggatatgaagaaacacagtaaacaaagccaagaagcttatgacagtcatttgaaatatatggatttgcagttgtggagtgattataagtttagcggaaatgaaaaatttaaagaatatgataagtatacggatgtaactattgtttgtaaagaattaagagaactaggggagtaccttcgtaattttaatgatgaagataatatagaacaaagtaatagatcgttaatcattcatcgatatgtttcaattgcctcatacacaagtgcagttttgcttagagactataacaaagatttgatagataaagatagagaactatgtgaaattataatctttgcctttggatatatgtttacgcaagcgtcagattttgaaattgtgcaggcggggaatggaatagaggcggtcatagtcggccttattcttatattggacgaagataatcgaaaaataataggcaatgaaaatcctttatacctgcttctcaagttggttcttagagactggagtgacgatagtcgtattactaagcagattgcggatactatttggaaatatagtaagggcgatggatggcgtttcatctatatattttcattgattgctgatcagtatgaaaaagaaataatgaagaatatgcgtctttctattgatgacttttttgaaaatcatcagaaaataatagcgaaggcgttgaagaaagacattgtggatgtaactgatattgattttacaaaactcagtaatgtagtgacatttaccataatagcgtttgtttctacaaatatgaaagaagcttttgtaattgctgagatgacaaaagatatcacaatgaagattgcatttggaaataaaaatagtataaaagaggaacgcagagaaattattggatatactttaaactatgttatctggtttgcagatgtactgctgcattgtgaggatgtggataggaaaattctcattgactcttttgtagggagggcagatataataggaaatgaaaatgtagagcatttgtttacatggcttatcaatgaccaagaagtttatgggaagatagatgaattttggagtgtatgggaactactgaaaccgcgaattattgctctcaataatgaaaaggagcggttttattattccagttataatggtccttttggcaaggataggattatcgcaggttatctgtttgcaaattctgcatggagggaaaatgttcatagatgtgctttgctttccgaggaaagagcagttttctttgatgactttattgctaaatcagaaagtattaaggcaatgttttatgcactagccaaattgcttaatacggttggaatggatccatataaggagattggaatcgaatggataaataaattagttcagaaggatcctgaatgcaaagtgacactttatgataataccttgttctaccttgaagaatatatcggaagttttacagctcgtcatagaacggaatttaggatggatgtaaaacttgctcagaaaacgcaaattatattggagtatttggtaactcaaggatcgcagatagcattcttcgtgagggagcagatttgatggagttttactaatagaattgagtgtatattcaaaaaaccaataaaaaatattagatgaagtaaagtcacaaatttggcagtataaactgcgaatattactattcttattccacattttgtaagacgttaatcgtaggactagaaattagaatgctggagaatgttatgatttttagaaaggtttataattggaggtatggtatttgtgtggatggcagagaaaagcagttattcacctcgtatattacacacttcttcgatcgattgaactataactgtttatattatatggatggcgaagaaattattaaaggtgaaacaaggagcgtgttctttgtgctgataaaagtgaatctgtggtaaagtatacattgcaaaaaaatgaaacacagatttttgcatcaaagtataagctatatcttccaagtgaagaagagctgtcacaggaattgcaaagagagtatagagcgttgtaatatgataaagaaaaataaaattaactttacttaattatagtgtaattttggtgggaggggtaaatttattcataaaggggtgattttccttcaaaaggggtaagaggggtagaattatcgaagaaatttacccctccactatgtaatgaaaatatttttgccatgtagtataaaacttccgtcccaccgcatgtggaaacggtagtactcttgtcccacaaatcacctgatagccatatagatgtaaaagtggaatttggagaaggtaatgggaagatgcctttggacgcaattgcagagagggcaaagaaataccagccgaaaccgaaaatcacatataaaatgatataggaatatgtcgaaaagaaatatgggtttagggtacatactgcgtatatcgcagaggtaaaaaggtctttgggattgacaatgtatgatgctccaaatgcagtagaagagttgaagcaaccaagaaagcatccgccgaaagagaaagtagaggctataaaagctgcacttaaatattttgaggtgatttgatggaagaaagtatatttcaaatagcagaacaaataaagcaactccataagaaagcttatgatatctatcttccattagttgatgatgtatgtaggcgagaagtatcggaaaaggaattatcctatttgcttgattatttgttggactttgcctgtgatgaaaaaatgttggagttatataaaaaggtgtgcagaaggtatttctatacttatccgagttgcattaagtcttatattgatgcatatcgggagatgttgaaagatgaaaatgaatgactgttcagtagaagatattagttaagaaagaaatagacagagtatttagaaagcgaatgatatgattacaggagggacaatgggaagaatagttaaggaaacgcttcatgcgaaaggcattgatattggtatttatacaacaaattttgaaagtgagtttatttcattgacggacatagctcgatataaaagtgatgatccaacagcggttatacaaaattggatgagaaatcgagatgtaatagaatttttgggactatgggaaagactgcataatccagattttaaacccctcgaattcgaggggtttagaaaacaggcaggagcaaacgcatttacaatgtcacccaaaaagtggatagaagctacagaagctatcggtattgtttcaaaagcgggacgttatggaggaacatatgctcatagtgatattgccatgtcttttgcaacttggatttctcctgaatttcagttatacattatgaaagactacaggagattaaagacggatgagaacagccgattatctttgaattggaatttaaacagagaaatttccaaactgaattacaggatacatacagatgcaattaaggataatttgattccaccggaattaacacccgcacaggtagtgtatacctatgctaatgaagcagatatgttaaatgttgttttatttggcaagacagcgaagcagtggaaagatgaaaatcctacagcaaaaggaaatatgcgagatgtggcaacgttgaaccaattgttagtgcttgcaaatttggaaagttataacgctgttctgattaatcagggaaagaatcaaaaagagcggatggaattactccgactgttggcagtacagcagttacagacattggaaacagtaagtttcaagaatttaccgaaattagagaaaaacttataaatggaattgattcgaataccgtatattgaatataatttgagggatgacaatggaacatagtaaattggaaaaacataaatttaaaaaagggaaatttattactccatggaatgacatgttaggcgatataagtgtaatgcaaaattgggcacttgagcgtttaccagagtatgtttggattgggcttgtttttgaggcatatggaaggaaaaaggggttggaaaaatgttataagataataattaaacttcatgaattaaatacaacaataaatgcaccgacaatttcaaatattttattgatggatgatcaaaaacaagaacaattttggaattttgtaaaagaaaatgttgaagaacacgttttagcaccacttacaattatttatacatatcgacagcataaaatatttaataagctttttcgaaacgatgaagattatgacattaaagtaaacaagatatgcgatgtattgaaaaaaggatttgatggacattccttttttgcaacagatattagatttgtagtgctttattttgttttgctacaaggaagactgcatgtcccttcacatataatggaagttatttgtgaatatccacacataagacatgaagatgaaagaatgaggttggcacggcccactattcgaagtttggaaatgttcacattagatatggagaatgtagataaaagaagtttggaagtattctgggagagaataagcgaaatgagtgaatgcgaaaatttttatatagagtataacaatatggctgaatatcctgaaaattatttggattttttgcgagaaatatttgaatatttaacaaggatatttgcctcaacagcgcctttaaatgaaaagtatttagttattttgggaatatcaacatacgcatataagagaatcaaagagttagtagagcatgatttatataatgaaatttccggtagaggaattataagaaatataatagaagactatataatgctcaaatatttgatacttcatgaaaaggaacatctaaatatatggaatgaatatcagtattatggaattggattatataaattgattatggcaagggagagaagtaccccatgttcctataaagatggacatgttaattacagatatcttgagttgcttgttaatgagtatatggatgaggagtatattaatatggatacatcttattttgatagacagaatattagaattaaggctaaagaggttggagaagaagaattgtataagctgttttacgattatgactcttcgtttgaacatggactttggggagcagtgcgggaaagtgctttgttaaaatgcgattcgccagctcaccaatatcattgcgtgcccgattatacaggacaacaaaagttaccttcggtgtggaaagatagtgttagaacaatgaacaaaatattatggattattaatgaatatatttctattcctaaagagttgatggaagaggtgcaaaagtttgaataataagtatctgatgcgagaattgttcgaaatgcaggaagaatacaggcagctactggaagaattgtatgatgaaaaagataaagatgaatttgtttatgttatagatgaaataagtcttttttggtattctaagagaaacgtagtagagttaattatggaaaatatttcagaagattttgatgcgtatctctttaccggagctacatatttggatatagaaggaggggaacattatccgtttgtttctttgggaaaagtacatattgtagatgatccattagcaaaatatgcagaagcaattaaaatgaatttaaatgacagtttctatagaatgatgaaaaaacagattgttttagcatttgatgataatctgaggatattaaaagagtgttttggaaaagtttttttacttccaattacattaataaataagttagaagaaggattggtaaaagagggctccgagaaggtgttagagagcatgtttaaagagcgattgtcgataaaagaaatgtttgcactcaaatcattatctgaattgacctctatgttgaaagatggtgtacaggaccatgttgcttttttagaaggggaagatagaaaagaagatattgtggttagatttgaaacatatttagatgagatgaataatccatttggagatatgcaaaatagtcacaagtttttatattcaattttgggatttatttcacaatcattacagattttattttgtgcagcacagtacaaaatgataccatatataaggtatggggtgacatttaattatttaacgattataggagaaaattttcaagatgttcctcgtatgcaagaggttatatttaaaacagcatttacacattctttttataagaaatttgattgggaattgacaaaacttattgaatttaacagatattgcgatgtagtagaacaaatagatattataggtcgattggaaaaacaaatggaaaataattatgaatttaatagtataaatttaaagaatatgaattgtatactcgatactgttttagtgaaaataagaacagatatcaataatatatttgtttgaaaatcaagcgtcagtcaaatggggataaatttgtggaagcctatatattaatagagtattttgtgggaaaaaggtaataccgttgaaaccgtcgtacttctcgaacgaaaaccgcagtaaatcaaagggctttgggatttttcgtgaaatatacaggtgtgtttgtggggtgttttgagcaaaataagttttcttttattgggatggggtaaggaaaaggaacgtttggacaaaaacatagagtccagatctttataaaaagcaaatggtatcaattgatttaagtacaataaagcgaaaggtatttttatgaatgggtgtaagtgtgggtaatacaacaagtaatgcatttcaatttaaaaatattgtagcagacatgtttaaatgtcgaggatataatgtttctgtgagcaatgatgtaagagattacggatatgatttagaggcatcacatggtatagaaacatatttgattgaagtcaaatattcaaaaacggaaactatatcgggtcacattgtttatgaagctgctctaaaattagctactctatcagacttaagagatgaagataatataccaatacttgttgtagctgctaaactttcttttaacacatggaaaagactagaggagtttggacgacttattgttattgacataaccaatctaatctacatgcttgaaggtttaggtgaactcaaaaatcaattattatcgcttttagaatactcaattgccgatctattaccagtagaacctaaaggtggattatttactaatgaacctagttactacatatcaaaggtttctgaagcagatatgctaatagaaagtttaaaatattggaatccacaagtaactgagagtgtagagtacgaacaattgtgtatgacaatattaaaatacctttttaagggtgaattatctctgtggaaggaacaagaaaaatcaaataatgatttatttcgatttgatctgatttgtaaaatcaaggatggtcaagttagcgctttctggtcaatattagaagattttttcaatacgaaatacattatatttgaatttaaaaactatactgataagattactcaaagggagatatatactattgataaatatttgtatcttagagctttgcgtggggtcgcaattattatttcatgtaatggagaagataaaaatgcaaaaaaggcgataagaggaactttgagagaaaatggaaagttaatagtaagtgttaacaattatgatttaatcaagatgattgaaatgaggataaatgatggggaacccgctgattatttatacgatattttagacgagctgttaattgatttagaaaaataggtatatgaaaaaaataagtcgtgaataaataaggtgaattttattattattgactattcaatgtatttagttttgttgtaaatataatatttatgtcttgaagtgctgaccatgttattgtagtgaaaaactagaaattctttaaggcgtggggtaatgatatgcttttgctatggagtataaaactctcgtcccatggcatgttgagacggttgtactgctggatcaaaagtccttacatcaaatcgttttgaaatttgagaaaagagttgagaatattaattataaaaatagtattgaaggtagagtgtaatggatataaaatctttgtttagtacaaaacaaaaaattcttgaaagcaaattaagtgtattattagatcatccagtgacaaaagggaatcattgtgaaagtgcttggattgatttctttagaagttttttacccaacaaatatgctgttgataaggggtttgtgtttgattctgaagggaaaatcagtgagcaaattgatattattatatatgacgcactatatgctcctttaatatttggaacagatgcaggagaaaagtatgtaacagcagagagcgtgtacgctgtatttgattctaaaccagagataaataaagcaaccttagaatatacgaataaaaaagttggaagtgttaaggctttgaaacgttctaggagaggagtaattaatgctggcaaatattatccaccacgagaattaactcatattattggaggaatattagccgtaaattcggtagaaatagatacaattaataaacacattaaattatatgacaatattgatattgggtgtgcaataaaatttcattcttttctggtagactggaagaataacgcaaagttatcatgggcgtctggagaagaaacaattttagcatttttctatatgattctggatgaattatacaagttgggtacagtcgcaggaattgacattagaacttatgcgaatgcaacattgaaacagtatatgtttgatttgggggacaattagaaaagatggattatatccaaataggcaagggacataataatttttaaagatatcgttttacttcattaatccctttctatcctaccaacaaaccatctcgcccgatagcaaaaagccataatgatcatgtaggcaggaaaaagaatgcttctaccaagacaaaaccaaagataccaaaacaaaaaaccaatacaccccgaacaccccaatcaccgaccaacatcaaaaaaatcaggaggaaaatcaaattgaaaacaccccacaacatccttatcatcctcaccggaggtaccatctgctcattcgccgacaaggcaggcaagcgagactctgatgcagagcgtgcgcatacgctgatcgaaaagaaattcagagcctccggctcgcgctattcctcagaggaatgtgtgacatttgacaaagagaagccccttgacattctgagtgagaatatgactactggtaattggaacatccttatctctaagatgagaacgtatgactattcaaaatatgatggcgttattatcctgcacggtacggacacccttgcttatacaggagcgttgctttcgattctgatggcgggcactaggattcctgtgtttctggtctccagccagcttccgccggatgacgatgaggccaatggcaacgcgaacttcaaggctgcggttgaactgatcgtcaatgggatagagcctaatatttatgctgtgtatagaaatacggaaactgacggatccggggaaacacagcgtatgtatattcactattgttctcatctgctgcagtgcgccaaccgttctgagaatttttacagtccggatatggctgaggtaagccaggagaacgctgtttttaaggggaaatcctccggcgaagagaagatgtacttgtatcacgactttgaactcttgtcttgtgttcttcggatcattccttatgttgggatcgattatgagcattactgcatgaagggggtcaaggcgattcttcatggcacctaccattcaagcacaatggcggtgactccatacaaggacgacgaatcgaagcggtacaccagtcaggccattctgtcgctcaaaaagcgatgtgatgagtgcgagcctccgatcccgctatttcttgagcattgccacagagacgcgtataattacatatctacaggcatcattttgaagtgcggcgctataccggtatggacgatgacttctgagatgacttatgtaaaattgctggttggctgtgcgcttggctacgaaggggaagaactgaaggaatttatgaatagagaaatcaacgatgaattcgtttatagagattagagccgtatgaaagcttaggatttggagacactaggaaaagtatatttttggttgacttagccaggaatgtttgctagtataaaaacggagactcagtttttggggaaattctaacagggagaacacgtcgtcgactggaagcgtgtttaagaagagtagtaagtttgggaacgctccatgtaatgatcaagtataaaatcagatattaaaagaggaagctttcgcttcaaaacgggtggcaccgcgggttactttgtatactcgtcccgagaatacgtattatatattggatatgtattctcgggattttttaatttaatttaggaggtagaaatcagatgtataggactctttactgtaatgatatccgtgaggagcatgtcgggcagacggttcagcttgcgggctgggtagatgcgattcgtgaccacggaggggtaatctttgttgacattcgcgattatacgggcgtgacgcagacggtaatccataacgaagaattattgaaaaatgtgaatcgggaaacggtgatctctttaaaaggggtggttgaaaagcgtgacccggacacggtgaatgagaagatcgcgacaggtattgtcgagttggtcgtaagcgagcttgtggttttaggcaaatcaaaaaatatgctgccttttgatgtcagcagttccagaaatattaaggatgaattacgccttaagtatcgctatcttgatcttcggaatccgaagaatcatgacaatcttgtgatgcgttccaagattatccgtcatttaaggaacaagatggaggataaggatttcctggagatccagacgccaattcttaccgcgtcatctcctgaaggcgctcgtgacttcctggttccaagccgcaagcatccgggcaagttttatgcgcttcctcaggcgccgcagcagtttaagcagcttttgatggtttctggatttgacaaatattttcagatcgcgccttgcttccgtgacgaggatgcgagagcagaccgttccccgggcgagttttatcagctggactttgagatggcgtttgcaacgcaggaagaagtcctgaatatttgcgaagacgtgatttatgatacatttgtaactttttcggataagaaggttacagaaaagcctttcaggcgtatcacttatgcggatgccatgatgacatacggctcggataagccggacttaagaaatccgctattgatctgcgatttaaccgcatttttcgcggatgtagccttccctgcatttagaggaaagccggttcgcggtatcgtggctgactgtagaggcaaatcgaagaaattcttcgaagattcactgaaatacgcgatgtcagatgaagtggctcttggaggattgggttatattactctgaaagagggggtatttgcgggtcctatcgcaaaattcctgagtgatgaaaagaaagcggagattacctcccttaccaatatcaaagagggagagaccttgttctttatctgtgatgataagaagaatgatacagagaagaaggcaggcttgatccgtacctggctggcgaaaaaggaaaacttagatcttattagagatgacgcgtttgaattctgctttgttgtggatttcccgatgtatgagattgatgaggagacaggagagactatttttacgcataacccattctccatgccgcagggcggtatggatgctttgcttggcaaagatcctacagaagtgctggcataccagtatgacctggtatgtaatgggatcgaactggcatccggcgccgtcagaaatcatgacattgatattatgaagaaggcatttgaaatcgccggatatgatgagcaggaattgaaggagcgtttcaatgcgctatacaccgcgttccaatatggggcgccgccgcatgcgggcatggcgccgggcgttgaccgtatggtaatgcttcttacggatgaagaaaagattctggacgtcatagcattcccattaaatggaaatgcgcaggatctgctgcttggcgcgccgagcgaagtaacgagccagcagcttgaggatgtccatctattagggaattccaatgctttggcaaaacatgctttcgcaggaagcggcgatggaaagtatgcgaagggaaaacgctctacattttccaatgcgcagcagttaaaccagatatcccttacagaggaagaagacacggaagtacaaggcatttttgaccggatgaagaaaaaagaagagatccttttgcaagtcgatacggaaaatgtcgaggaaatggttcatgtaatgcctatgaacaatgtattgcgtgaggatgtcagagaacaattgtttacaagagaaagtttacttgaaggcgcgcctatgcacaacgaaaatagttggcaggttccaagacttgtaaagtgaggtggatgatatggaatattatgcagcaaaaataaatgaaaacggcaccattgccgtggatgacagcattcttgtgaagggtgccgagtcaacgtatggctcgaaaattctgatgggattcaagcctttattcagcgctgaggcagtagagcgcctggagaagaacggatacctggtatccgggaaatgccatgtgggcgagttcgggctggatctggtgggcgaattctcccactatgcacaggaagatacgaaactggaaggcgcggcagcagcgctggtagcaaaatccgatgtgaaagcagcgcttggagtggatgtaaatggcgcgccgagacgtgcggcggctcttgcaaatgtagatttcctcaagcccacctacgggacggtgtcacgttatggaatcatttcaacagcggcatctggcgagcaggtaggcgtatacgcgcctgacacccaaggcgtaaaagaattgatgggtgtgattgcaggccacgatgataaagatggaacaagtctgaggacccagacctatgaatatcatacagatgaggatatcgctggcaaacgtgtctgcatcgtcaaagaattattagaaatcgcggatgcggacacgcaggaaaacgtgagagcgtttgccaaaaaactcacggacaagggcgtgaccgtggaagaaatttcttgcgacttttttgagatggcgaatacggcatggcagattctcatgtccgcggaaacctgtaataatatatccaggtttgatggcgtaaaatatggacgtcgtgcagagaactataaaaatattgatgaactgtatgtaaattccagaacggaaggatttaacttccttacgaaggcagtcattttatatggttctgacgtactttccaagaaccggtataaagattgttatgataaatcgttaagaatccgccgtgtcgtggcggaaaagtttgcggcgctcatgaaagagtacgatgcggttcttacgcctgcctgcagcaaaacaagttacgagcgttatgatatttatgcggcctttgaaaaggtttatgaagaaagcatatttacctccgtggcaaatctgatcgggattcctgccctggttagccgcaaagttcagttaatgggcggacattttagcgaaagcattcttttaagtatggctggagccgttgaaaaggaaggtgaataagtatgaattatgaagttgtaatcgggcttgaaacgcacgttgaattaaaaaccgaatctaagatattctgctcctgcgggggccatgccgcggcgaagactccgaatgactgcgtatgtccggcctgttccggcatgccgggcatgcttccggtaatgaataagcgagtggtagaacttgcggttcttgccggcttgatgttaaactgcgagatcagcagatatacgacatttgacaagaaaaactattattatccggatctgccctgcgcataccaggtcacccagatcaaccatccgatctgtaccaatggctgcgtacaggtaaagacgtccgcaggcgtccgcgacattcacatcaagcagatccatatggaggaggatgcgggaaagctggttcatagcggcagctactcttatgtggactttaaccgtaccagcgtaccgcttattgagatcgtaacccagcctgactttagaagtgcggaggaagttatcacataccttacaaatttaaaatccatgttccgctttagcggcatttctgaatgcgaggaaggcgcaatgcgctgcgatgttaatatttcggttcgcgaggaaggaagccaggagtttggcgtccggacagaaatcaaaaatatgagttcttttgaagcgatcgaaaaagccatcaattatgaagcgcaaagacatatggacgcgatcgagtatgaattagaagaactggttcaggaaacaagacgttatgatgacgcaagcggcaagacctttgctatgcgtaacaaggaaacagaagcggattatcgttatttcccggatgccaatctgatgccaatcattattgatgatgagtggattgaggagattaagaagaacaggccggtggaaatcaacgataaggtagtggaatatagcgaagccggcatatcagaaaaagaaatagatatgatcatagccaatcaaaatatttcccagcttctggatggggttgtcgcgcttggatgtaacgccaaagatgcggcgtcctggattctcacagagagcgtaggcctcttgcgcaaagagggcaagaccatagatgaactatccatttcgccggaaaaactagcagcaatcatcaaaatggtagatgcgggcgagatcaaccgcgtatccggcaaaaaaatcctggtggctgtacttaaagaagacgtagatcctgtcgcgtactgtaaggagaatggctttgacaaaaaaatcgatatggctgtggttgataaggtcattgatgaggcgatccaaaataatgcgcaggcagtcgcggactataagaatggcaaggcgaaggcgatccagtctgtatttggcgcttgcatgcgcgaattaaaaggcatcgtcgagcctgcagtcatcaaagaaatgttagaaaacaaattaaaataaaaggttttttcgacaaacagtggttgtcggttcagagtacgaaaagtggtgttggagcaagaactccgacgccacttttttaagttatatctgagaagagtaacgcaaagaccggaagataacgaacaaaatcatcagattcccgcattgtgaaactgtcgcttcaactataaaataaagaaaacatgacatcatgacgtcataaagacgcgccaagtacatgatacagagggggattatatgggaagaggcaggccatattatcagcagatgcgggatgatattaagaagaagatacagtgcggagattataaacgggggcaatatctgccctgcgaaaagaaactggaagaagaatatggagtcagcagaacgacggtgagaagcgcaatcagcgagctggtgcaggatggctatctctatattgtccgtggcaagggaacaaaggttgcatattcaagactgaccgataataatccaaatctgctgagttttacagagatcgtaaagagtcatggatatgagccccagatacttcagcggtcttttgagattataagggcagatgagaaacttgcgaaaaaactcggaatcggggccggagaggaggcagtacacatttatcgcgtgcggggcacggatgatgagccagtgtcgatcaatgattcttatctgccggggaagatcctgggagagcaaggtgcagaacttttgcttgacggagagtccatgtatgagaatctgaagagacattatcatatagcagtgacagaagtaaaggaagaaatctgggcagtctcggcaggcaaatatgaagcagagacgctggatgtagaagagaatgcgcctcttctggcatttgagagggaatcctacagccaggagggaaccctggtagaatacagcaaagtgatataccgatccgaccgctacagacatgcggtcgtgatgcgaagaagagaggaatgaggtgggaattgtggacagagcgaaaaaggtggtcgtgattggggatgtatttgcggacatgatctctaaagtacggggatttccggaaacgggaggcagaacattcggaacctcatttatgaggaacagcggagggacgggcggcaatattgcggcaggacttgcggttctcggaatggaggcttccattgtatgcggcctgggagatgatgaaaacggggaatttttgctggaagaattaaagcagtccggggtaaatacagagcatgtgaaggttactgccggcttgaagtccggggcagtgccgataatggtggatgaggacggagagcgggtaatctatgtactggtcaaagggtctgcgtttgaagccatagagccggaagatcttttgtttttagaagagatgaatcccgatgcgctttgttttaccggagtgatcataggcgcgcatccagtggaggagtcggccattctggcggcaagaagatggaagggcagggcaaagctgtattttgatccgaatctctgctatccggcagaccaggttccggaagagatcaaaaaagcgacaagagaactggcagatctgtgcgacgtggtgcttaccggggagacagagatgcgtgcgcttggcctttctcccaagaaagggcagtgctatattgtgaaatgcggaggaaaaggatcaaaatggatggatgaaaaggaggtggagaggtatcagattccggcgacaaaacaccgtccgacggatacgaccggtgccggagatacattcatggcagcatttgtcgcagcagaggccgaaggggcttcggtggagaaggcaatgcgttttgcgtctgtggctgccggaattgcggtcacaaagacaggggcgagaaacatgccaaggaaagggcagattctggaagttctagaagagtacgaaaaagaactggaagaaaaaaatgagaaaaagacaggacgacaggaggaagaaaatgggagattggaatgagtattattttccacaggaagtattggaacaggcagacgcagtcagaaacagcatggctgaactggaaggcgagatagaaaaactggccgaaaaatacagggacgtacagaaagtatatattgtcggttccggcgactgttactttatcagtctggctgcggcagaggcgtttcggaaactagctggaacagaggcatacggttatgaggcttatgatttcttcttagaaaagccaaagactgacgggaatacgatggtgatcttgttcagttcttcaggaaaatctttatatgtcctgaagtctctggaatacgtattggaaaatgggggcattgctattggcgtgaccaatcatcaggacagtcctctgggaagagacagcagcgaagtgctgctcacaacttccataggagtatccagaacatttccgacaaagacgacaacaagcgcccttgcgctgatgtatcagctggctgctgtgcttgcggataaaagagggaccgttgatggaaagacggctgcacatttaaaaaaagaactgatgattcaggtgccggagatgatagaacggatatataaggaagaaagagaactccttcgccagggcgcccaggcttttctggaagcgcggtgttatacctatgtaggaagcggcccttcaagaagtgcggcgatggtgggggcggccaagatcgtagagacctcccggggacatgtgacattctgtaacgcagaggaatacatgcatctgcatggattttcggtaaaaagttccgatgcggtgatcatcattgcgaataatcgttcaaaccacagggaaatacaggtggcagaatatgcgaaggatcagagggcaagagtgttggctgtgggagatgtcccctgcggcaaggcttcagagaattttatcagtgtggcaccatatttaaaggaacttacagaatggggcagcagcatctgcgcaatggtcgttgttcagctttttgcctgcgaactgtcccggctatcctataaagacccggatgcgcctcacgatgtcaacctgaaaaaggtgattgaccttttatatacaggcccagttgcaggatggaatgtataaaggatagggagaaaatatggaagtattaaagattcaatcagatcagcacggagtgctggaccttaccagcatggtaaaagatattgtagaaaagagcagcgtgtcggaaggactctgctgcgtattcgtacctcacacgacagccggtcttgtgatctactcggggattgatccgaaggggcttctggatttaaacgatacggtgaagacgatggtaccagtcaggacggattttcatcaccagtgcgatccgccatcagatgccgcgggacatatcaagtccgcattgtttggcaattcgatcacgtttattgtccatgagaatgaattggtgctcggcggctctcagtacctgtatttttatgagtttgacgggccgagggaacggcaggtattggtgcaggtaaccggcacggcagaagaataactgggaaagtacgcagaagaaatggagagggttatgttttcggaaatatttaacagcaaaaaaccggtgataggtatggtacatttaaaagcgttaccaggcagtccggggtgcaaggattcctgggaggaaattcttgaggccgcgcttgcggatgcggaagcattgtgtgacgggaaggtagacggattgcagattgagaatcagtttgactggccgttccttctgccggaacagattggtgcggagactacggcatttctgactgcggcaggatgcgcggtccgcagggaacatccggaggttcccttggggattaacatccacctgaatgggggaatccaggcggtggcagcagctaaggcatgtggtgcagactgggttcgggtgtttaatctggcgaatgggtacatctcgaacagcggctatgtagatgcgatcggcccaagacttctgcggtaccgcaaggcagttggcgcagagcatgtgatgatattcggggatttccaggtgaagcatggaagccatgcagttacggcggaccgtaccctttgggaaaaagcccgtgacgtggagatgagtatggcagatgcggctgtgattaccggaagcgccactggaacagcgccggatgtacagagtatccttgcggtaaaggagcacctctccataccgttgttgattggaagcggcttgaatgaagcgaatgtgaaggaactgtggccttatgttgacggagcggtgatcggcagtggatttaagaaaggggcagacctaaagcagccagtcgaccgggaactggtcatccggtttatggagacggtccatcagcaaggttaaaggaagaagaatgagtatgaagaaaatatcggtaatgattgtggatgatgaaaaactggtgctggaagatttaaaaacattggtcgactgggaagcgctggggtttgagattgtagcaacggcttttaacgggaaacaggctcttgaaaaattcaaaacctttctgccgcaggttgtttttactgatgtgaggatgccgttcatggatgggctggaactgatcaggaggctccgggagacggcaccggaagtgtgcatatttctactgacagcatatgaggactttacatatgccaggacagcgatcaaatatggggtaaaggattatgtgataaaaagcacgttggacgaagttacatttgcgcagcttctgaagaaattattcgaggatatcagcagacagaataaactgcgggatatgttaaagacgaaacagcttttggaatatctggaacttcctgatggggaggaaggcgcggattattccgggatgtaccggaaggcttatgcgtatatcgttatcgagcaggatctgccggttgtatttacggatgacacagttcccgaggagatgatctgttccgggaaaaagatcgcatccatcgcagtgccggagtatatggatgaatctgagatggctgcggtcagtgatctgccgggagggaggacgctggtgattctggatattccggaagtatcccagaaaaaaattacagagacagtacaggcttatgccagagaaatcaggcagcggcttaggaccgccctgggatactcttttaccgtatatgtggcggatcgcaaacagacgatcgctgaactgaaacggctgtaccgcggcgcaaaggaatgcttccggagaaaatatctgcttggcagcggcggaatctattctatgatatccctgcccgatacgaagggggagcaaaagaatccggcagtagataccgggctcatccagaatctgactgacagcaaagatatggatgggatcgcgcagtatctggatgtaatctacaaagaggtggagggcagccttgattaccatggcctgaaacagatatccagggaattatttatgctgctgaaaaagaattatgcccatctgccgaaacagatgggacaggatttcagcactgcctctaatttctcggattggctggacagccggcatatcagagcgtggttccagcgtcagtttgaaactttaatctccggaaaaaagaagatgcagctgggggaatattcaaggcctgttgttctggctatggaatatatctttaagcattatcaggagaatacgctttccatcaatgagattgcggacagtgttcatttaagtatcggccatctgtgcgggatatttaaaaaagagacacagaaaacagtaaaaggttatattacagaagtcaggatcgaggaggcaaagaaacttctggaagaaggcgagctgaagatttacgaagtctcgcttgcggttggatatcagtcaagccagtatttcagccagattttctataaaatgacggggacttaccctacaaactggcagagagataacaggaggctgtagattatgaaaaaatcgatcagagaaaaaatatcaggacgcattatcattgtcggagtaatgatgttctttgcgtccgtcgcgctttcttacggcctgtttattccgaagatggagcaggatgcggtaaatggggctggagatacaaatgcggaggtcatcaagacaatcgacaggcagattgcctttgtccaggattatacagaaaatctcgcactatctgtagcgcagaatcaggagattctgcgctattttgaaatcccgtctacacaggcgaaaaatgtcgcctccctgcatttgaataacctgatcagttatgaaggaacggtacgctgtgtattgattgcagatgagagcggcgttatgctggattccctgaacaaagttgagaaagaggacagggagctggtgaaatccaagtggtataaaaaacttcggagtacaacctatggaagaggagtatccgaggtatatcaggtggatattaataatacaagccattacacggccgcctatcttaagaacttttattacggcaataaaaaatatacttataccgtattcatggacttaaatgacatgatccgggattttcaggtgctggcagggaaacaacttgattatgcggcgatcgcggacagcgaaaagaagatcttcatatcggtgggggataagaaatgggagaaacaggccgtagtggcggcggcatcagatcagatgaatacgctggaagcggtggcaggaggaaccggttttgtaaaaacctcgctcaacagcaaatggcgcgtcatctcttatgtcgcggacaagactatttttatgtctttttccttttatgtcgttgggattatgacggtactctttttgtttacgcttgtgactctcggaatactgtctaaagcaatcgggaatatactgaaacctttgagcgaactttcaggcagtatggaagaggtcgcaaaagggaatctggactgtaagcttacgcagtttccggaggatgagatcggtatgctgagccggacctttaatcagatgacggtagacttaaaagacagcctggaactgctcgcaaagaaagagcggcaggaacagcagatcagattcagcctgctgatcagccagatagatccccactttatctacaatacgattaacagtatcaattatcttgcgagaagaggccggtgtaatgatgtcatcaaagtaaattccgccctgatttcgattcttcaggaccggctgagagtcaatgacatccaggtgacggatacaatagccaatgaaagaaaagtggtggaacagtatcttgtcatcgagagatacatgtatgacggagatctggaagtgtcttggaagattgaaaatgaacttatgacggagcagatcccaaagaatatgattcagccgcttgtggagaacgcattgtttcatggcctgattgatgaggagagcggagaactgaacgggaaaatcgagatagagattcaaagggacgaaaaggatctgatcctaagagtaagcgacaatggaatcgggatgagcgaagaccggctgaaggctgtgagagaagagatataccagccggaagaaagaggcaaaaagatcggactgtctaacatcggccggagactttattatctgtatggaagcagcgacggtatccgcatagaaagcggggagaatgaggggacaaggattactctgaaatttaaaggagaatatttcgaagagcattgatggatggggtaatgtgcacaataaatttgtgaaaacgacataaaaaacagacaagatattcaaaaaacgaacaaaaaatgaagattgtgacggtgcgtattctttttcagaattctataattaatacaagaaaaagataaaggtgtgaggaatacggatgggtaataattatttatttaaaggagaaggaatcagcaaatcattcggcagtacccaggcattaaagaacgtcacgatcacaattaaaaaaggagagatccaggggctgatcggtgaaaatggatccggcaaatctacgttttcatccatttgcgccgggatccagaaggccgacagcgggacaatgtacctggagggagaaaaatatgtgccgaatgggtccatcgacgcgatggataaaggcgtcagcatggtggtacaggaacagggaacggtcgggaaaatcacggttgcggcgaatgtcttttttggaaaagaaactgattttgttaaatttggcgtattaaatgtaaaaaagatgaatcaggaagcaaaacggatgctggaaagtatcggcgtgacagagattgatccaggcgcagtcattgatactctgacatttgaagaacgtaagcttgtcgaactggccagagcgttatatacctcgccgaaactgtggatcgtagatgagacgacgacagccctgacggtaaacggtagagaaattctatataagctgatgcaaaatatccgtgaccagggcggagcggtcctgtttatctcccatgatattgaggagattatgaaaatatgcgattccctgaccattttaagggacggcgtgctgacagcagaactttcgaaggacgaattcgaggaggaaaaaatcaagcagctgatgatcggccgtgagatgtctgcgcattactaccgtgaggatgagaaagaaaactatcaggaagaagcagcgcttgagacaaagaatctttgctgccagtccttaaaggatatcaatgtggtgctgcacaaaggagaaatcctgggcgtgggaggactgagcgactgcggaatgcatgatcttggaaaagcaatgttcggccttctgaaaccggatcagggacaggtgctgatgaacggcgcaaacaaggtgaaaagcgcgagatggtctgtggagcatggaatcgcatacctttcaaaaaaccgcgacagagaggcattgatgaccatctgcagtatcaaagataatatctgtcttccttcgcttaaaaatctggctaaaggaggaatcataagccggggaagcgagaaaaaacttgcccagaaatggtccggggagatggaagtgaagacagagtcagtggaaaagttctgcaataccttaagcgggggcaacaaacagaaagtagtcctggccaagtggatggggaaaggatcagagattatgattctggactgtccgacccgggggattgacattgggacgaaagcctcgatctaccagctgatagagaaattaaaaagtgaggggaagtcgattcttctgatttcagaagaattgccggaactgatcgggatgagcgacaggataattatattaaaagacggaaggctttccggagagtttttaagatccgaaggtttgacagaggcgaagctgatacaaaaaatgatataggaaggcagtaggatgaagatgggttacgcaaaaaatcgtgtcagaaattttatgggcagttatttttcatttatcgggctgttgctcgtagtcattatatttcatgtgctgacagagggaaggctgatcagttccagaaatatgatgaatattttcaacaattttttcagcattggacttggttctgtcggagtcatgtttttgatgtcgcttggggaactggatttatctgtgggggcaattctgggattctcggccgccatcggagccttttcggcagagatacataccgtatggatacttccggcatgccttcttacaggactattgatgggttcattaaacggagtgcttgtatcaagacttaaagtagaatcttttatcggaacactggcagtctcattcatcgcgagaggccttaccacatatctgctaaatggatcggtggggattccgctgacgcagcgggtctacgacaaaagtgcagtaaaggtcacggtatttatcatcgttgcggtagtattttatattttgtttgattatacatcttatggaaaggcgtgccggtcggtgggggcgtccgctgatgcggcaaggcagtcgggagttgcggttgaacgagtaaggatgaccgcgttcatgatctcaggactgctctgcgggcttgccggattcttcagccttgtcaggacatgcactgcttcatcaaagaccggggatgcctttgaattcgaagtacttctggcggtactgtttggcggcatgcctctttccggaggatggtctgtaaagttccgggccgcaattgtcggaagtattgctatggctgtgatgcagaacggaatgtcgctgatgggcattgacgggcttacacagcagcttgtgcaggggatcatcctgattgtcgtggtagtgatctcatttgacagaaaaaatacggtagtgatcaagtaatacagaagatattttacaggaaatcttaccctgtgaaaataaaaagaaaaggagagaagaactatgaaaaagaaaagatggaggctattggcagccgtgctgacgcttgccatggttatgggaatggcagcgggatgttccggcaaaggcgagagtgaaaagaagacggctgacagtgggaaaaagggagatgacccaaaagcatttacgatcgggttcccatggcagacttcctctacggatccgacattcgtatccatagagaacaatgtaagagcagcggtagaggcggcaggaggagagattgtcgttgtggaaagcgatctgtccgcagatgacctgatcaacaatgtgtctgacctgatcagccggggagtggacggaattattatgatgccggcgtcagattccatgcttgcaacagcgaaccagatgtgttcggacgcaggcgtgtatttcggaacgatgttccggacgatcaatgatgaggagattaagaaagaggtctatgattctgaatattatgcaggcggatgcaatgaggaagatgaagaagcggcatataatattgtaaagaatatggcaggacagggagtcggcaacctctgcgtgatcaatattgcaaaaggagatacgtcttctgacttaagagataaaggcgtggaaaaaggggtaaaagagacaggcattaatcttttaaacacgacttatggaatcgcggcacagacagatatgacaaaaacaattgaaagctacattgcggcttatccggaactggacggcatccttctggcaggaacctattgcgacgcggcgcttccgacgatcgaaaaggccttgtctgatcatggaatggccggcaaagtaaaggtaggaaggattgattttgactttactatgggcgagtatctgaaaaacgacacgttccatgtcgcttacggcggtcagcagcagattgacccgctactgtcaaccgtcattcttgtaaatagagtgatcggaactccgatcgtagaggacaagccatttaatctgataacaaattatctggagctgacttccagcgaagaggcggatgaatatctgaaatacttccttggcaaaaatgcggtatttactccggaagagatcaaagatactatgatcaaatattatgacgacagcatcaacgaagatacatttaaggaaatagtaaagaactttacagtggcagatgttgctgcaagacatgaaggaatggaagattagggattaatatgaaagaaatcatgaagaaatgtggaaaaacattattgcttccggtaattgtgtatggagtttttctgatcatctgttttaaaagatttaataatctgaactgcgtatatacgattttcctgcagtcaatcgtgccgacgattacggcctatgcctatgcatttatctacatgagcgggctgttcgattttaccattggttccaggatcatcatcggcggacttgtcggaggcattgcctccgccaggttcgggatggcaggacttctgattggggcgctggcggcaagcgtcctggcagcggcgctcacaggaatcctgaactggatctgcaagattccttccctgattcttacgatggctctgacaatgatttttgagatcatggggaagaatatttccgggaagttcagttttgtgagcatcgactataaatatgcggcgcttggatctgcgccatatattattattgtacttttcgtatcagcggttgtgttctattttatatttaatcatacaaagttcagctatcatatgagggcggtcgggagcaatgaagcagtatccagaaatgcagggatacacgtacagagagtaaaggtattgtgctttgtgattggaagtctgtttgccgcagtatcggcagtgctgacgatcagccagtcaggctctatgggggcacagacgaatcttgggagtgcggcgcttttattcaagcctttgatgggaattatcatcgcggtggttcttcagccggtgtgtaatatgaccatcggcatctttatcagccagtttaccttgaatacgatttttatcggactgatcgccgctggatttccggatacattccagaatatattccttggtattttcctgctgattgttatggtttttacaaacaatgtcgagggactaaaagaactgcttcacaagaaaccggcgttaagggctgaagcgtcctaataatgtattagagaagggagagacgacagatggaatttcctgtaattaccgaggaagagagaagaaggctgctggcacctccgtcagggaaagtggaaatggtgctggatacggatacttataatgaggtggatgatcagtttgcactggcttatgcgctgatgtcgccagagaaacttgatctgaaagcagtttatgcggcccctttttcttctgaattctttgaccgccagttaaagagcaagaaagaacgggtgacggtaccaatgaccagcgacctgaaagaagggctggaactaagttataaagagattatcaaaatattcaatatgctggaccgctcgccggatggcagagtgttccggggatcggcagagtacatgaaggaaaagggggtgcctgtggaatcagatgccgcaagagatcttgtcaagcgggccatggaaagcgaagatattctttatgttgtggcaattggggagatcacgaatattgcttcggcaattctgatggagccggagatcatccggaaaattgtggtagtatggctgtccggacagccgatgtactggcctcatacgctggaattcaacatgggacaggatgtattggcctcccagctgatatttgactgcggcgttccgcttgtattgatgccgtgtatgacggtagcctctcatctgacgacaacggctgcggaactcaaggaaagattgatgggaagaagcaggatcggaacgtatctttctgacatcgtcatcagccagctgagtccgcaggcagcggacaatatgctttccctgttccggcttacctatcttcaggaagcggatgactatccggactatccgctggacgatacagaattccaggcgatggccccttccaggattatctgggatatctccacgatcggctatatggtgaatcctcgctggtgtccgtctctgcttgtaccggcaccgcgtctcactgacgacgtcaggtgggagcacgatccgaggagacataaaatccgtgtatgtaatttcgtataccgggatgggatcttcggagatatgtttgaaaaactgggcaaagcgccaaaataaaagaaccccctgccccttcaggattgagggacaggggaacggagggtgtgcttagcacactcttttttgtgtgactgctatgataaatacttagataggctaagcgaggctcaatccacggatttgcttgcaaccagcggcactacgacacctttttcaacatcaaccaatccgcagtccgttaacttgagcgcgggacttactggaagtcccaatgtacacaatgacatgatcggattataatggcggtatcccaacgtttccaggctttcttttacgccgcccagcatccggccaatgtcatccgcgggcagttcggacaggattccgcacacaggaagcgggagttcggccaaaatgtgtccgtgctctacggtacagattccgccctgtaattcgatcagccgtctggcagcagttaccatgtcgtccacatgggagccgattaccataaggttatggtggtcatgatagtaggtggttgccacggctccctgcttcaggcagtcgccggttacaaagccatagccgatattgccgttctttccatggcgttccagcacggcagccagcatgcagccgctgtcctgccatttcaatctattattttccacttccatggaaaccagtttttctttggtctgcgtacggccgtcggttacttcgatcacgcggacctgcacttgcttctgatctgtggagaccacaggctccagatccttggcctcaatcttgtccagatgtacggagtggtagaattcctccgggaagtggtaagcgctcaacgtgcgtttggcctcccctttccagaagatttccttgccatctttgaacacggcgtctggctcaaacctatgaatttcggtttctttcaccagctggaaatcggctttccttcccggagccagggcgcctcggtctcgcaggttcatgcgcctggcgggagtataggacgcgcagtaaatggcctgtgcaagcggaaatcccatttcgaccgcttttcttacgatataattgagctggcctttttccagcagcgcgtctgccatggtgtcgtcggtgacgaagcagcagtgttcatagagctggttctcggtgatatattccagtatctcaggcttcagcattttttcctggatttccacaaacattccattggcgaaccgctgccggatctcttccagggagtgctcggtatggtcgccgtcgatcccctgatagaggaatttcgcaagatccaggcccaccagagagggacaatgtccttcgatgactgcctggggatcttcttcccggaggtaacggaggaatttggtgatctccatctcagtgccctttacgatctggcggtagttcatgacttctcccacgcagacgacgccgtcttcctgcatcagatgcttcatttcatcaaagccgatgatgcccccggtggtctccagatcttcgttggtcgaaggaacgctgcttgggattccgtaatagatgtcgatgggggagtctttcgccccgttgatcatctcatggattccctgcacgcccatgacgttcgcgatctcgtggggctcggaaaccagcgtagtgactccgcaggaggcggcccgctctccgaaggaagcaggggtcatcatagaactttctatatgcatgtggatatcgataaaacctgggagcatgtaatatccgctgccgtcaattacctttttggcgttgatattaccttcctgagccgtatccacaaaatagatcctttcccccagtatatacacatcagcgggcgtgaacattttcagataggagttatacagtttcgtattcttgactaatagatctacgttctccacttggcacctccttcctacagaatggaataaaagtaaagcaggcagacggccaccagaatccacataaccggacggatttcttttattttgccggctgagatcttcatgatcacataggtgggcagtgcggcacagatgccgtttgcaatgttatttccgaaaatggtgaatacgatgcacacataagccgggaaggcttcggtgagatcgttgaatttgatgttccgcattgcccccagcatattgatgccgatgtacatcagcaccggcgcggtggcggctgatgggatcatcagagcgatcggcgcgaggatcagggcgagcccaaagaagatggaagtaaacacgacggtcagtccggtcttgccgcctgcctccacgccagcagaagattccagataggtcgtcatgctgggcatgccgaataatgcgccaaaactggtagccacagcgtccaccttgaagcatttgtcgattcccggaagattgccgtcttcatccagatatcctgccttcgccccaacgccaagaacggttccaaaggtggagaaaaagtccggaacgaataaggcgatcaaaaatggaatataggcaaagtttaatgcgcccagaaagtcaacatgtaaaaactggccgcctatatttgcaggcatggtaaacaggctctccggcatctttgtgacgccgaatgggatgccaaccagcgtagtgagggcgattgccagaatcatatcgcctggcacgcttcttgtcttcaggaccagtaagattacgaatccgatgacagcgacgatcaccgtaggggcggtcagatcgccgaatcccagactttttttcgcttcgtttgcgacgatcaggccgcagctttttgcgcccagcagtgcgataaacaggccgataccggcacttacggcgtgctttaggctgacggggattactcttactacagcttcgcgaaggcctaaaaaggagattacgataaataatacgccgctccaaaagataacgccggctgccacatccggtgcaatgccgtcattggcgatcatagcggttacgattcctacgctgccaagtcccggcgccagcgcaaatggacggttcgtatagaatgccatggcgcaggtcgtaaggattacgagcagaatcagcacggtaaacatgacatgcttgtctaatcctgcggactccatcatattcggtactgttgccagcacgtaggccattgttacaaaggtagtcaggccggccagaagttctgtcctgacatttgaatgaaactctgacaatttaaactgtctttccaaccactgtttcatatagattgttcctgcctttctctggagtgcgtccagaaaggcgcgcactctgttgtattttcttgattctttcctttttacattgtatgataaccataacggtaagtctaattcatgttaatcatcaatcctattccattttggaatagcccggaggaaacttatgaacatacacgagttgaactatgtactctgcatagccaagcatcagaatatgacgaaggcggcccgggaactgtatatctcccagccgacgctgagcaagcatctggggaaacttgagcgggaactgggaattaagctttttaaccgggtggacaattgctatatcccgacttacgcaggcaggcgttacatggaatatgccagccgcgttctggaactgacccggaattgggaaaaggagctggaggacctccggtccttgaatgacggcgaactgaatgtggcattcccgctgatgcgaagttcctgcatgataccatggattctgcccgcgttccgccagctgcatccaaatatccgcctgaattttctggaggagacttatgccatccaggaacgcctgttaaatgacggccggatcgactttgccattttcagcggaggcgacccgaaccccaagctggaatacgaggtgctggggcaggaagagattctgctggccgtgtcggcggacaatcccctggcaaaggatgctgcctgcgctcctttaaaagagggcggctatccgatcgtggactggtcaaagcttcataacgagaagttcatcctgcaccatccggagcagaatacgggagcgatcaccgcgcatcttctgaaaaagcacggaatcacgcccactgtaccgttctatacgcgtaatacgcaggcggcgcttcttctggtccagcaaaatgagggaatttgctttgcgccggaaacgtatatccgcaacatgacgtttcatacgccgccggtctgcttttccttaaacgatcccgaagcgttcgccaccaccatgatcacctatcggaaaggggcgtatctgtcggcgtatgcacaggattttattcggatagcgaaggagtattttatggggacctcgttatgattagagataatttaaaagagttttagtattaataaaatattatatggattagtaaagcagataaatgatctgaaaggatgaggaatatgggtggaagagatgcttctaggggttttttataccaaggatttgcgtccgtattagaggcgttaactgataaaaataaatgggacaagatttatgttgagttccctacaacagatgataaggtagatatagcattaggactacaaaatcaaattgttaaatgcatacaagtaaagtcaacgataaatacgttttctaaatctgacatcaagatatggatcacggatattataaaggatatggaaagtccggaatatgaattattcttaattgggcagtgtgataagtccgccaatacatttataaagtcaattgaaaagtattatgaaggaatgattgataaagaagcaaaatcttcgttaagtggttttgatacagagttgctcaataataagacaataaggttttctattttgccatttgatatagatatattagaaaagatagttagagattcgttgcaccagtatatttcatataacaaacaaatgatgacgtttgaccaaataaggtttattgcgtcggctactgtgaatgaccagatgatttcttcaacacatggcagaggtgttgacagaaaagaatttgatgaggaaatggaaaagcgtattcttcttgttgctgataagtattcccctaaaagaatacctatcggtgtaaaaagttttacccgagcggtaggaagtttagaagaagatgtagataagtgcttatcatttgttgataagtttgctggccggaagttaaaagatgaatatgattggaacggagatatatacagagatttgaaagaatttctgctgacaaatacaagcaacaggcatgcctatcagatattaatggatacgcatatatccatagccttcgccgcaggaagaattcttgatagtaaatcaggcgtcaatatcttcccagtacaaaaatcttcaactaatggcactgtgttatgggatgtgaaattgtcatctaaaaaagactatgcaaaatgggatatattgcacgaaaagtttaatgagaatcaatatgattcggcattaatattaaatgtctcccgtgatatttataatgatgtggcaaaatacataaaagaaagaaatttgcccattgggcgtatcattaattgtaagttaaaaggagtagaagctacaaatttttctatagaagatggaacacatgccactattttagctaattcagtttatagcgctattggcaaaagaagtattatggaacggcgtgcaacactgcatatttttgcttctgctccaactgcatttatgtttttcttgggtcaaaattcatctggatttggcaaatgcattttatacgagtacgattttgaattaaagaattcttgtacgtattcgcagtcaattagttttactaattaaaaaaggattgtatctatctattataccgttagattatattggaaaattgcaaaggaggatgcaccccatgtactactcaacagactacatatcgcccctgggccgtgtcaagctcgccgctgatggcgaagccctgataggcctgtggctggaaggacaaaagtactttggcgggaaagtcaaagaagaattcgaggagaatagaagcctcccggttctggaaaatgcgaaggactggctggaccggtattttgcggggaagaagccggagatatccgaactgccgcttgcgccgatgggaagcgcatttcaactaggcgtatgggaacttctctgcgagattccctatgggcaggttaccacttatggggagatcgcgaaaaaaatggcagcgaggatgggaaaaagcagcatgtccggccaggcggtcggaggggcggtcggccacaatccgatctctatcatcatcccctgccaccgggttgtaggcgcgaacgggagcctgaccgggtatgcaggcgggattgagaaaaaggtaaaactgctggagcacgaaggcgtggatctgcagaaattttttattccccaaaagggaacggcactataatttacagcagaccagtataaaatagcaggaaggaggaagagagcatggggatttggacagaaaagcactagcagcaaggcgttagtgtttcgtacgccttgctgatcagggaactaagggacagaccaatgattaggaggcaaacgatgtcatatttttattaccagtcaaaaaggatttattacaccgaatcaggaaatggagcacctgtattatttttgcatggcaatactgcatcttccaaaatgtttgaattattattgcccttatatgaagaacggttccatgtgattctcattgatttcctgggtcatgggagatcagaccgcctggagaagtttccggcggatctctggatggaggaggccagacagaccactgcgctgcttgcgtatcttaaactgggtaaggtgagcctggtgggaaccagcggaggcgcgtgggcggcaatcaatgcggccttggagcggccagacctggttggcaaagtagtggcggatagttttgacggccggacgctagcggatgatttcgcaaggaatcttgtcctagaacgggcaagcgccaagaaggacgagatgggagtcggattctacaagtggtgtcagggagacgactgggagcgcgtggttgacatggacacagaagccatgatccagtgcgctgaaaagaaactgccgttattcattaagccgttgaatgaattaaaggtaccgcttcttcttatgggcagcgaggaggacgagatgtgcaggaaggattttctggaagagtatgatgcaattgcgaaagaaaccggcgcgcagattcaggtatttcctacagggaatcatccggcgctcctttccaatgcagagcgggcggcggaagccattggcagatttcttaaatagtatgaattaagagaagggatggaacatttggatgttccatcctttttgcggttataggaaaagcaaaacagtaatattgacatacaatggttttggtgctatgttttaggtaattcgaaggaagggaggaagaaagatggggcataagctgaaagtaattcttacagtcatcttaattgcaagtttgggcatttttctatcttccggtcttcaattctacgacgcggataatgacgcaggcagttctttggggcaggaaaggcggggcacattatcccaggcggactatacggacggcaatggcatgcatgtcttagacggaggctgtataagcacggaaaaagagacagaagcggtctgttcgcagatattccagggcttgaagaatcttcagaggctgccagtctggttttacgcatttatcctactctctatatgcatctggcagaagagggcatttttgtcatatctgcaattctatttatttcctttggcacgattcttgtgcgaactgtgtatccgattagaaaaagacgggaagaaacgggactttgctttctaactcttatatttatagaaagaaagcagggaagaaatgaagaataaaaaattaaatatttggattgctcttggggtaatctttctttttgtgtacctcgcagtcttcggctgtgggggcggcatcaagggaatccgggatatgcgctttggcatagatatccggggcggcgtggaggccgtatttgagccggcaggaacgaaggaaaagccgacaaaggcggaactggaaatggcaagggaagtcatcgagacccgtctggatgcccagaatattctggaccgggaggtgacggtggatgaaaaggcaggcaacattatcgtcaggttcccatggaaatccgatgaaaaggactttgacccggaaaccgccatccaggaattaggccagatggcagagctaacgttccgcgggcctgacggcaccgtgtatgtaaaaggctcggatgtagccagaagccgggcggcgctggatgagcagaagagaaacatcgtggaactggagtttaccagcaagggcgcggaaaaatttgccgatgccacggagaaactggcagggcagaatatgggaatctacatggatgaggagatgatttccaatccgctggtgaatgggaagattacaggcgggaaggctgagattacaggaatggcctccaaggaagagagccaggatctcgcggataagattaattccggggcgctgccgttctctatggagacgacgaattacaataccatcagtcctacacttggaggccgggcattgaatgcgatggcggcagcggcaggaatcacgatggttctgatctgtctatttatggttgcgtggtatcggcttccgggcatcatcagctgcctgacgctggcctttcagatcgcgctgcagatcctggccatctcggtgccgcagtatacgatcacccttccgggcatcgcggggctgatcctgtcgggaggcatggctgtagatgccaacatcattatcagtgagcggatcagcgaggaattgaagaaaggaagttccgtgaaacgggcggttaagaacgggtaccaaagggcattttcttctgttctggacggaaatatcacgacggcggccgtggcgggcattttgatgatatttggctctggcacgatgctaagcttcggatatacgctgctgaccggcgtgatcatcaatctgctggcaggcgtgtggatgtccagaagcatgctgaactcggtaatccggtacggcttttttaaccgggagaagtggttccgcaaaaagcgtgacaagaaggtgctgcattttactgaggcaaagcggtatttcttcctggccagcattgctgtcatcgtctctggaaccatatggagcgcggcaaatggcgtgaagctggatacccagtttactggaggtgtcattttaaaatacacttactccgggaaggcggataccggacagatacaacagaaagtggaggatatcgcagacagaagcgtcagcgtccagacatcggaagatccctctacgggggagaaaaaactggtactgacgctggcgggaaaaaacgggctgtctccggatcagcagaagcagattctcaatacgctgaatgaagggaaggataaccagtttcagacttccgagacgtatgcggtggagccctatatcggagcaaaggcactgaaaaattccatcatagcgatcatactttcttttctttttattattgtatatatccgcctgcgcttctcttcgcttggaggactggcagccggggttacggcggttctggcgcttatgcatgatatctgcatcgtgctgttcgtatttgggatattccggataccgctgaacgatgcgtttgtggcggtgacgctgacgatcatcgggtattccatcaatgatacgatcgtattgtatgatcggatccgcgaacacaggaatacgatgaaaaggaaaggaactttggcagaactggtggatcttagcacgacggaaactctggggcggtcgatcaacacggcatttaccgtgaccctgtgcgcattcattattctggctgcctcgatcgtctaccagatggaatctatcacgaagttctcccttccgcttcttgcggggctggtatcgggatgctattcgtcaatctgcatcgccgcgcctctgtgggtatggtgggaagaacaggttcaaaaacggaagacagggatgaaaaagaaatgaagaatataaaattattttttagaaatcagccgccggggcggctcattgcatcgggattcgcgcttgtaatcctgctgggagcattcctgcttctacttccagtttccataaaagacggagcagaagtatctgtgatcgacgcgctctttacttccaccagcgctgtctgcgtgactggactgatcgcgatggatatcgcggatcattttaccgtattcggtcaggcggtggtggcgatcctgatccaggtcggaggcctgggcgtcacatcaatcggcgtaggcctggtgctggcggcaggcaagcgggttggcattaagagcagggtgctggtcaaggaagcgctgaatgtggatacctacaaaggaatcgtaaggctggtgaaggcagtactcatgatgaccctgtgctttgaggcaggaggggcgcttcttagcttcctggtattcagccaggattacgcgccgctgcatgcggcggggatcagtctcttccattccatcgccgcgtttaacaactcaggattcgatatcctgggagggctgcagaacctgatcccctatcaggatgacgttctgctgaatctgaccacgtgtacgttgatcatttttggaggcctgggctttctggtgattctggacgtattaaagcagagacgttttagcaggctggccctgcactcgaaagtggtgatcgtgaccagtctggccttgctggctgtgggaacggtcttattgaaggcaacggaagatattacatggctgggcgccttcttccagagtgtttccgcaaggacggcgggattctccacgtacccgatcggacagtttaccaatgcgggcttattcaccctgtgcgtgctgatgttcatcggcgcgtcgcccggctctaccggaggcggcatcaagaccagtaccttcttcgtgatatttcaggagatacggggcatgtgcacgaagaagacggtccacgccttccaccggagcatctccaggcagaatgtttcaaaagcatttatgatcacgattctttctggcacggtcgtaggcattgcggtatttttgatgtgtattctggaaccggatttcagtttcatgcagctcttctttgaagtgatctccgcgtttggaacggtggggctctctaccggaattacgccagatctaagcgtggcagggaaggctgtgatcatcctggtcatgtttacgggaagagtcggggcgttcaccctgctgtctatgtgggtgaaccgggcagagccgaatgcccggtattcagaagaaacaatatcagtaggttaatcaatgaggtgaatgaatatgagaaaaaaagaagaaactgcatatggagtcattggacttggacgatttggagaggccttggcaatcatgctggcgcagtccggaaaagaggttatcgtggtagaccgggatgagagtaagattaaggaaatgcgccaatacacggaatgcgctttcgtgaccgagaacctaagcgcggaaaccttaaaagagatcggcattcagaactgcgacgtggtcgttatctgtatcggcgagaaagcggatgtcagcatattgatcaccatgagcgtgatcgagatgggagtgccaagagtgatcgcgaaggcgttcagcccggagcagggagccgtattggaaaagatcggggcagaggtggtctatccggagagggatatggcgctgcggcttggaaaaagactgctgtcaaacagttttattgattttgtctctttgtgcaacagcgtggagatccgccagctgcaggtgccggagagtctgctggggagtacggtggaagagacgcagatgcgtcgcaaataccgcctcaatatcatcgccatcgtaagcggagaccatacagagatcgaggttatgccggattaccgcctcaagcagggagatatcatcgtggtaatcgggaaaacagaaaatattgatacatttgtcaacataatttaatgagaaaggaaggtattttatgagaaaaacgaagattgtctgcacgcttggaccggccacagatgaggggaacgtgctggagcagctgattcaggaagggatggatgttgccaggtttaatttttcgcatggcacgcatgaggagcagaaggcgcggctggaccggctaaaggaattgagaaccaagtatgacaggcccattgcggcgatgctggataccaagggaccggagattcggattggctgttttaaagagggagaggcggttcttgaagaaggacagatatttacgctggtatccagggatgtggaaggaaccagggactatgtctcaattacttacaaggaactttataaggatgtgagcccgggggattccatattgatcgatgacgggctgatcgagatggaagtgaaggaaatctcaggggaggacatcgcgtgcctggtaaggaatggcggaaagctgtctgatcagaagggagtcaatataccggggactgagctgaacatggagtttctcagcaaaaaggaccgggcggatctgctgtttggaattcaggaggactttgactttgtagccgcctcatttacccgcactgccgaagacatccgcgagatgcgcctgcttctggatgagaatggcggcagagacatcaatattattgcgaagatcgagaatcagcaaggggtggaccacattgatgagattatagaggcggcggacggcatcatgatcgcgcgaggcgatatgggcgtggagattccgctggagcgtgtcccggtcatccagcagacgatcatcaggaaggtgtactgtgctggaaagcaggtgataacggcaacccagatgctggactccatgatggagcatccaagacccacccgggcggaaacctccgatattgcgaatgcgatatatcaggggaccagcgccatcatgctctctggagagacggcagcaggaaagtatccggtccgggcgcttcagaccatggtcagggtggcatcttatatggagcagaatatcaattacaatgagatatttaagaaacgggaccgggcggaagacccggatattaccaatgcaatctcccatgccacctgcatgacggcgatggatctgaaagccaatatcatcctggcagccagcgagaccggatttacggcccgcatgatctccaagtaccgtccgggctgcatgatcggagggtgctccagttcccggaaggtatgccgccagctcaatatgtcctggggaatctatcccctctataccaaggaggaatacagttcggagattctgtgcctgcgggcaatggaggcggcaaaacgccacgggcttgtagaagatggggataagatcgtgtttacaggcggagtgccgcttggaattccgggaaagacgaatctgatccgggtctgcatcgtgggagagtagaagaaggcttaagccttgtgcatttatagctggcaattccgtctcaaaacaagtataattgtaccatacgatatccgcgggcgtgcaggatgcccgcggcaccaaggaggaacgatttcatgaagatagagatgggagaatcattattctattcctggcttcgccatgtcaaggaatgccagctggtgcagaccaactggaaagtatcgcccaaatggacgctgcgccatgaagaggagctggagaggctgatgaagcttgtggacgggcattttcatacccaatatcgatatagcattttcaagcagaacagttctcttgcacagatcatccagcagggagagtgcgacgctgtgggcatatccattcaaaatggagagaacagcatctatgcggtggatgtggcgttccacggcgcaggacttaattacggtaccaaggaggatacggtgatgaaggtcatagccaaaagcgcccggacagccatgagcctgtatggatatatggaagcaaaggctgcggagatcatcttcgcatcgccgaagatcaatcaaggaattctaaatgatctgattccgtgcattgaggagttaaatgatctgttttcccgggagggctatggatttaaagtgcggctcattgccaatgaggaattcgagagttccgtgcttaagccaatcctgctgatcagtgatggaatctcagatacctcggaactttttatacgcagctatcagatgttcaaaatgtttgacaatgaagcggcagcgccaaaaggcgtgacggcatcggcagaaactgtggaaagaagcaatgaaggccgtcccagcgaagaacaggaggacagcgtctatcgggaattaaaggtgggaaaacttgcccagatagtgctgggaaggatgctggaagagggaagagccagcgaggaagaaatcaggcttctgcaggacgctgcatacagcaagcgtacctttgaccttcagtatccgcttctgacgcgggcagacggcgagtatgagaaagtccggtattatgcgaagcccctgaatatccggggtgtcaagtatgtgctgtgctcccagtggttcgagaaagagtccaataacgacaggccatatctgcttcggtggatcaaaagccatcaggaataggggagccacagaactatgacaatacagcagttaagatatgtgataaaaatcgtagagtgcggctcgatcacggaagcggcgcggcagctcttcatatcccagcccagcctttcggcggcagtgaaggaattggagacggaactggggattgagatctttcaccggacaacccggggcatcacgctgtctgccgacggtacggaattcctgtcctatgcccggcagatcctggagcagacccagctgctggaacagcggtatctgaataagaagccctccaagcagctgtgctcggtatccacccagcactacgcctttgcggtcaatgctttcgtcaacctgatatccggcattgatgccaacgagtatgagtttacgctgcgggagaccaggacctatgagatcatagaggacgtggcgaacttcagaagcgagatcgggatcatctatttcagcggctttaatgaacgagtcatgcagaaactcttgaaagagaaccatctgatattccatccgctcttcgaagccagtccccatgtattcatcagttcttcccatcctcttgcaggggaggaatccgtcactctggaggatctggatgattaccccttcctggcatttgagcagggcacctataattccttctatttttccgaagagattctcagtacagcgccccacaagaagacgattcatgtcagcgacagggctaccttgttcaatctgctgatcggcctcaatggatataccatctgttcaggggtgcttaacagcaacctgaacggcgacaatatcgtatccgtgaaactggagacggacgagtggatgcgggttggctttatctgcggcaataaggtccacttaagttccatggcccggggctatattgcggaactaaagaagctgattgcccaaaatggcttcactcttctgtcataagacagccgctatgcagccagcaactggtggatggcttcatagattctggcggctatgtacgggttattcatggtatagaggtggatgccgtcaaccccatgtgtgatcagatccacaatctggtctatcgcgtaagcgatgcccgcgtcgcgcatggcatccggattgtgctcgtagcgttccatcatggctgagaacttgtggggaagggtgacgccgcacagagagaccatccgctcaatctgctttttattggtcaccggcatgatccctgcttcgatgggaacctggatgcctgccagggaagcccgctcacggaagcggtagaaatattggttgtcaaagaacagctgagtgatcagatgacttgcgcctgcatcgactttcgtcttcaggttcctgatatcatcaaagatatccgcggattccagatggccttcgggatagcaggcagccaggacattgaagtctccatgttctttgataaaggcaatcagatcgctggcatggcggaagtctccgggcacatagccgccggaaggcacgtcgccgcgaagagccaggatgttctcgatgcctgcctccttgaaatcggacagctggcggcatacatcggattttgtcagactgatgcagggcagatgagccacgctttctatgccgtattcattcttgatccgggaggcaatctttagggttgccttgcagttctcgctgccgcccgcgccgtaggtgacgctgataaaatcaggatctaggtctttcagactgtctatggtcttgtagatcgtatcaacaggattcgtccgctttggaggaaatacttcaaaggacaggacggatttattctggaaaagttcggttgtcttcatagcattgattcctttcatctgtgttgggacatataatatcaaagaatcctaagataggaaaatatgaaaaatttatcggttgacataggaaaagactataacccttgaagaaatcagggacatgtgagattatgagatatagagaaagaactggcaagaaacttgtgagaagaggtagaatgtggataagaaaggtaacaaatcagagcatataattaaagtagtataccccgattccattgcagaagagatggagatcgagcctggggatgtgcttcttgcgattaacgatacttcgatacaggacgtatttgactatagatatctgataaaaaatgaatacatcgaggtgctgatccgaaaggcggacggcgaggaatggctgctggagattgacaaggactatgacgaggatcttggattggaattcgacaatggtctgatgagcgaataccgcacctgcagcaacaagtgcatcttctgctttattgaccagatgccgccaggcatgcgagagaccttgtattttaaggacgatgattccaggctttcattcctccaggggaattatattacgcttacgaatatgaagatggaggatatccagcgcatcgtcaagatgcatctggcgccgatcaacatatccatccagtccaccaatccagaacttcgctgtaagatgctgcacaaccggtttgccggggagaagcttcagttcctggatgtcttatatgagaatcatatcgagatgaatggacaggtggtagcgtgcaagaacgtaaatgacgggccggagctagagcggacgattgacgatctgtcccggtatcttccctttatgaggagcgtatccgtagttccggcgggaatcaccaagtatagggacgggcttttccctctggaactgtacgacaaagaggaggcgggcgcggtcatagacatgatcgagagccggcagcagagatattatgaggaatatggccttcatttcatccatgccagcgatgagtggtatatcacagcccagagagcgttccccgaagaagagcggtacgacggatatatccaattggaaaacggggtgggcatgatgcgtatgttcatcaatgaattccaggaagaattggaagaagtccttgcgaaggaggcatatccgggaataaaggaaagcctgaagcggacgatcacgattgccacaggaaaactggcatttccgacggtcagggatttcgcccggcagctgatggaagcgtttccgggacttacgattcatgtatatgccattcagaattatttctttggagagacgattaccgtctccggactgattaccggacaggacttggtgacgcagctaaaggagcagaaagagcatggcgaagacctgggagacacgctgctgataccatccaatatgctaagaagcggcgagcaggtattcctggatgacctgacggtgggtgacgtagaagcggcgcttgagatgaaactgacggcggtggaaactgggggcaaggaattcattgatgccattctctatccagattatgagatggataggaataatgagaactttgtctatataaaggcgtatgataaaactggagaatagccagatcatataacaataaggttgttggaaaagaggcgggatatggaaagaattctgatcgtagaggatgaagagaagatcagggaggaactgagcacggccttggagagaaagggatacgcctgtattctgatcgaccagttcgaggatgtcgccggccagatcgaggcagcggcgcctgatctggtgctgctggatctgaaccttccggtacaggacgggttctttatctgccaggaagtaaggaggcgcatggacgttccgatcatcgtggtgaccagttccaacagcgatatggacgagctgatgagcctgaatctcggggcggatgattttattacaaagccatataacatgcatatcctgcaggctcatatcgcgacggtgcttcatcgggcgtacggcaggaagcagaatatgatgctgacccataagggcctggctctggatatcctgaagggaaggatctcataccagggaaaggaggcagaccttaccaaaaatgaacttggaatcctgaaactgctgatggaaaacgccgggagcattatatccaggaatgatatcatctgccagctctgggagatggaagagttcgtggaagaaagcacgctgaacgtgaatattaaccggcttcggaagaaactatcggaacttgggcttgaggattacctgatcacaaaaagaggaatggggtatatggtatgaaaatatccgaatacatctgcgataagggggcggccatagggattgggcttcttgcaggccttgcgtcaggcgtattcctcgtgttcatggaaatcgaactgcccatcgtagtagttgtggaagtgatctatttgatgggattctttggaacactggcatatgattttttccggagaaagcagtattacgatgaattggccgaggcatgggaaggcctggaagaaaagtcctatctctgcgaggtgatagaacagccgggcttctacgatggcaaagtcatgtaccagatcgtaaaacagagcggaaagtatatgaatgataggatcgcggaaaagcagcaggaactgatagactataaggagtatgtccagacctgggtgcacgagatcaagacgccgatcgcggtccaggaacttttgatagagaatagcaggaatcctctgacttcaagcctggaagaagagaccaggaagatagaagcatatgtagagcagatgctgtactatgccaagagcagcagtctggaaggcgattatatcatacaggcggtgggactaaagactttggttatggatgtcatccgtaagaacaagaagatgatggttggcgcaggcgttatgccaaggctggagcagctggattatgaggtgcttgcggatcccaaatggatggaattcatcttaagccagattgttaccaattccgtgaaatattgcgataaaagccgcaagccctatgtatcctttgagggaaaagaggaaggacggatggtagtccttacggtagcggataacgggattggcattcccacgcaggatgtgtcaagggtattccaaaaaggattcacaggggaaaatggacggctcttcaagcagtctacggggatgggcctttatctgtgcaggaaactttgcgacaagatggagatttcgatggaattatcatcctgccagggcgaggggacgcagatagccttttgcttcaagcgggcggacgcttcccggtagggcggcagagtatagaaagaagcgaataagacaaatagcaggaagggaaaaccgggagtcggaaaggctcccggtatttttgtcacattttctgtggataaacataacaaaaatgtaatgttactgttagttagttgcgtagaaactctatgtatacagtgatagactaaatacaacgacaaagagtctgaaaggagtagaaagatatgagcacggttttgaatgtagtaaatctggaaaagttttataaaaataaaggaagtatcacaaaagcagtcaaccacatcggatttgaggtggaagaaggcgaatatatgggaatcatgggggcatcgggaagtggaaagacaaccttgctgaactgcatctcgaccattgaccaggcgacggcgggacagatatatgtaaatggaacggatgtcaccaagatgaatgagaagagcctggcgaggttcagaagagagcagctgggatttattttccaggatttcaaccttctggatacgctgaccgggcgggataatatcgctctggcgctggctatcataggtgaaaagcccaaagcaatcgaccggaaggtggacgacgtagcagcggcgctggggatacgggatatcatagacaaatacccctatgagatgtccggcgggcagcggcagcggattgcatgcgccagggccatcgtaacgaggccatccctgatactggcggatgagcctaccggagcgctggattctaagtcggcaggaatgttcttggaaagcctggggatgctgaacgagcgtatgaaggctaccatactgatggtaacgcatgacgcatatacggcaagccactgccgcaggatcctgtttttaaaggacggaaagatcttcagcgagctgatccggggctctgatacaagaaaggaattctttgacagaatcatgcaggtggtatcgcttttaggaggtgaaaaagggcatgtggcttaaaagaaagatgtcaaaaaaagtatttcgccagctggcccgcaaaaatgtgaagaaaagcgctaaggattatttcatctattttttcaccctgacctttgccgtctgccttttttacatgtttaattccatcggtgcccagtttgaggcgtttcagattcccgacacgctgaattatctgtctgcggcccagggggcgatggtaggaatatcggtgattgtctgtggaataatcggcttccttgtcgtgtacgccaatcgattcatgatgaagagaaggaaaagagaatttggcatttattcggtgctgggcatggagaacaaggatatccgaaagatcctgatgaaagagaacatcctgatcggatcgacatccctgatctctggaatcgctctgggcatactggcatcccaggccctgactatgataacgggcaagattgccgggatcgcgcttacgggatttacttttgtcttttcgataaattcattgatcgcggcggtattattctttggggtaacctttttcttcgtccatctctttaacataagagaaatgaagaaactgaaactgatcgacttgatctatgcagaaaagaagaacgaggagatggcagaagggaagaagagaagttcgctgatgctgctttttggcctgcttctgattgtcgcaggatacggcgttatcttcctatggtccggcaaagagttctttaagagcatgggacttggaagcgtgatcattggcgcgggaacgctcttgctgttcttatcctttgccggtgttatgatcgggttcttgaagaaaagaaagagtttttactaccgcaagctgaaccttttcgtagtgaatcagctgggaagccgtatgaagagcgcgggggcgtcgatcgcagtggtatgcttcctgatgtatatgtccgtctccatcatgggggtcgggatggggatggggcagagcgccatcagcatcaaggataaggctgcgccctatgacgtcagcattacggaatactatgacggaaggcttcctgaagacgaggttcgggcgaagggaatcaaaaatgtccttacggagcagaattcgaaagtcgtgcctcttctgggggagaccgcggaaatcacgttctaccagttgaaagatctccgaatgaaggaactgtatggagaaagcctgaaagacgagccggatgtgcggaaagtaatgggaaagagcccagtctgggtagtcggggtggacgactataataatgtgacggcgatacaaggcaaagaacctgtgacattggggaaagatgaatatgccattgcctacgatatgccggaggcaagggaaatgctaaagacctatgaaagacaccataagagcccggtagaagtaggaggaacgcctctgacgatgaagaaaggcggattatacaaggctacgcttaatgacaggaacgtattgattaatccgggcatgctcattgtcccgcaggaacttgctgagaaatcagagccttacatgtccgtgctgaacggaatgttttccggggacaaaaaagcgggttatgatgcattcgttgacgatatggcaaaaataaaagaatttgactatgtaagccagaaggatgttcaggtagagattatatcaaacaaattaatctcatcttatatcggcagctatcttggcatcacatttcttgtgaccgcaggcgcggtactggcattgcagcagttaagccagtcggcggataataagaaaagatacgccctgctttataagatgggggccggcgactcggcaatgaagggatctcttctgacgcagatggtcatttacttcgggctgccctttggaatcgcggccgtgcattccggggttatcatgggaggcatgtacaggcacatccaatacttgtcagcaggagacgtggcaaggaatatcctgcttgcagcgggcctggcagtcatattgtatagcgtatactttataacgacgtattcaggaagtaaaagaatcttgaaattataagacggttatataacaagttgatttgaaagatgtattatacttggcataataaatatcacgaataggaggtcccaataatacaaaagagaaaggaaagcgctttatggatattttaaaaagattacaggaacatagcagaaatataccagagcagccggcaatcgtatctgagacggagcagttaaactatcgtcagctggaggaatattcaaacgcgttggcttcctatcttaccgcgtcatacgggaagtcaaaagagccgattgtcgtatatgggcacaagaatgtgttcatgatcgtatgctttctggcgtgcgtgaaagcggggaggggatactgccccattgatgtgagcgtgccagcggagcgtgcggccgcgatcatcaatgaggcgaggcctccggtagtgctgatgccagaaaatgcgaagtttatggcaggcgagtcagagccgataaacctgagtcagattcaggcaatctgcagggagggtgacgcaggaccggatgccgacgcttgggtcaaggatggggatacgttctacattatatttacatcgggaagcagcgggactcccaaaggggtaaagatctcgctgggatgcctgaatcatttccttgactgggcagtggaactggggattccttcgaaggagaaaagaggcagtacctttcttaatcaggctccattttcatttgatctgtctgttatggacctgtatacatgcctggcctgcgggggaacgctgtgggtgatgacaaaagaggtgcagggggattatcagaagatgttcaggcttatggaagattcagacgtcaaggtgtgggtgtctacgccatcttttgcagatgtatgcctggcggatcagaaatttgcacagagattgcttccatcgctccgggcatttttgttctgcggagagacgcttacgaacagaacggcgcttcaattgcaggagagattccccaaggcagtgattgtgaatacatatgggccgacggaatctacagtggctcttacggaagtgaaagtggaccgggaactggctgtaaatgagaaccctcttccaatgggccgtgtaaaacggggatctgcgattgagatatgggatgaacaaggaaaggcaatgcctgatggagagtccggagaaatcatactaatgggcgatacagtaagtaccggatatcatcaaagggaggaactgtcacggaaatcattttttatgtgccgaagaaacgatgaagttctacgggggtatcacacaggagattccggctatctgaagaacgggatgctatactatctcgggaggctcgaccgccagatcaagctgcatggataccggattgaacttgatgatatcgaacagaaccttctgcggctggatagagtaaaaagcgcggtggtaaccgcgaatgaaagagatgagaaaatcacaggccttacagctcatatcgtatatgaccgaaaggtagaagacggccgtcaggaggcacgcagaatgaaagaagaattaaaagagttcctgccggaatatatgattccaaagagaatccgttttctggatagtatcccaatgacggcaaatggaaaggttgacagaaaaatgctgcaaggtgctgtaagatgaatttctttgagggtttaaacttttttacatacttgattgcagccttgtcgggagccgcggtgctgggaatactggaaaagccgctgagacattacgtattcttgctttcggtgctttttattactgcagtattctggagcaagccgcagcagttcttatatcttctgatctatgtattgctgcagatcgtccttgtcaaaggctatctggccataaggaagagatatggaagaaaggcgggaatctaccatatatttttggtgctttccattgcgcctctcttgatcaataagatcggcgggctgttccatctgtctgtcctggggttccttggaatatcctaccttacattccgggcggttcagatgattattgagatctatgatggagtcatcgaggaagttcctgccgtggagtttttgagcttcctgctcttttttccatccatcagttcaggcccgatagacagaagcagaagattccatgaagattatgaaaaggtctataccaggcaggaatatctggaactgctcggagacggattgatgaagatcatgcttggcctcgtatataagattgtcctggctgccttatttgcaaagtggatggaagctgttgcgtatggagaaacgtggtatgctggcatcggatatgtatattgctatggcttcaatatgttttttgactttgccggatattccttgatggcagtggggacaagctatatccttggagtcaaggcgccggataactttcggcttccgtttatcagcaaagacattaagggattttgggaccgatggcatatatcgctgtcgcattggttcagggattttatattctcaagatttattatgacggcgatacgaaagaaatggtttaagaccaggctgacgggcgcttcgataggatttattatcaatatgctcgtgatgggagcatggcacgggctgacggtatcctatctgctctatggcctgtaccacggagtactgcttgccctcacagagatatatcagaaaaaggcccggttttataagaaatacaaaaagaaaaaatggtatcaggctgtttcatgttttgtaacattccagctcgtaatgtttggattctatatcttttcaggaagaatgatcgagacggtagccggatttataaaataatttcttagaggctgatataacgttataaaggtaagaaagaggatatggcgtataccctctgaaatcaaaaatataaggagaagaaaagatatggaagagaaattattagatatgctggaaagaatctgcgaggatgatattgtgcgcgaggaatacgatctggatttgatcgatgaggggcttctggattcccttgcctttgcagaactgcttgtggacattgaggaagagtttgggatcgtaatctctccgtccgaggtcgggcatgaagatatgaatacggtgaataagattatggcccagatcaagcagaggagctgattccatgaagaagatagcggctttttttacagctcttattatggccggaattacaattctgggaatgcatgtgtattcttccgggaagacagagtttcacagcccggattttgggttttggacagcggagcagaagtttcaggctccggaagcggtcaagagcaacctgaacgagaattcccttgtgatcatggcatcctctgaacttgagcatggcaagggaacgccgtaccatccccaaaatatgttcaaaggcaatgtatttcagccgatgctgatcggagccggccattatcagagcctgtcccatgcgatcacgctggccgcgatcgagccggcgatggagaaccggaaagtagtgctgctcgtatctccccaatggttccgtccccgtgggattctgccgaaggcgtacgcgtccagattctctgaaagcgcgtttatcgacatgctgaaaaataagaatctttccgaggagacaaaacgggaaatcacagacagaacgattaatctgctttctgcagaccggacgatgcagaacagaattatatcttataaaaaattgctgatcgagcatgagaagaatccaatagaaactgcaaaattcaaggcatacaacgcatttctgaacgaaaagcaaagacagagcgtcctgatccagtccgcagtagatggaataagaagagatcaggaaacagggcttgagatcaaggagccagactgggaggcatcttatgcaaacgcagaaaaggatgcaaggaaaatgacgtccaacaaccggttccagatctccaacaaatattataactggaaggtaaagccacagcttaaaaagaggaagggcagcagcgtgtcatcaagttacctggaatcaccagaatataaagacctgaaatgcttccttgatgtatgcgaggatttagagatagaacccatgatcgtgctgcttcccgtcaatggcaaatggtatgactatacgaaatttcccaaagacgggctggcagcgtattatagcaaggtatcagatacggtgaaagagtatcaagatgcgaaactggtagatctctcggctatatctgatcaggactattatctggaagatacaatccacatcggatggaaaggatgggtgaaattagatgaaattatttaccagtttggcggcaaagatcaaggaacatcctaaaattcagtttttgctttatgtagtcctgttctatgtcctgatcatgagtttatatatctatttgatacatgcgaatctttctacagcgccaacatttgtatacaatcaattttaatggaactttgcttatgcgcttgcaaatccgccattgtggctttctttcgctttatatagggcatcatccgcaatcttggacaaagcggtataattgtccgtgcgtctggcaatgacggcgcctgccgacatggtgatgaccggaaggtttcgtttcctggcctcgacggcgatggtactattgatgtcttccataatcctcttggctacggaataatcgccggtcttggagacaaagatggcaaattcatccccatgaagcctggaagccaggtcgatggtccggatacgtccgatgatcatctgggcgcacagcttgatgacttcatcccccacactatgtccataattgtcgttgacagccttaaagcggtcgccgtcaatcatgatgaggatgctgtgctcatcctcctccatagagtgaagctggtgagtgatgctttccttaaatgaatggaaattcataagccctgtcagctcgtcgatggcggcagctttctgggcggcagtaagcgcaagttccaggcgtttctgcgtctgtcccagttcgacataggcagccctgagttccctgtttttctgctctttggttatgcgtccgaggatatagatcagcagcagttccagaatgagaagcggcagaagccatatctgcagggatgactggagcatggacattaccggtaccagcaccaggaaatgataggtatcgccctttagcaggtagccatagtagtttgtcttgccgatcttcagagccagcggcttttccggatgtttctttagcctcgagaagtccttgtggaagtccttctggaaggaatagtaggcatctagggaatctgcctgctgctgaagtttttctttgtcagcttctgatatatccccggcctcctttaagttcttctttgcctccttcaaagcatccctggtctcatcaagagaattgtacaggctgccgccaagatagctggcattggtgctgccaagtatggttccattatcgtcgaatatcatcatctgctcatcaggataggcggccagggaagagacaagttcctggatatctcccatcttgatgtcatatgcgaatacagtctctccgtccggctgaagctgggagatggtggagagaatataatgattagcataactcatataaggcggggtaaatacgactttccctttgccggccaccgcatctttataccacgggcgctccgtggctacatatccggtatcctcatactgggaataaggggtgtcccaactgtatagatagcggccctggtaatacatatagaggccgtcgaaggtatctccctcgatctccagcatggtggagtctatactttttagataatcccaaatatcatctgggtttggattgtttttaatttcccttgccatcatattggagaatagctggaaagaatggatatagttatccataacatcttccatcttagcgcgggactgttctgcatgggaagaaaaactgtcacggatgtaggaggattctttccttcctatcagtagaatggcagcaagattgacgattaaaaatgctgcgatgaaccagcgaccatttccatgcttcttatcacgtttcataatgtaacctccagaggaattagatccgtcgtaaataatacggccatactcattctatcatattgatttggctgtattcaataggagggagacaaaagaagcgacacttttgccgcgattgaaaacaatcttatgaaatgctataatacggatatgaatgggcatggaccagagaatattaaggagaagagtgaatggagagtcaggagaagaaacataagcgccgggtacgttattccggcgcttatcccaagaattacagagaaaaatataaggagcttcagccggagaagtatgcggataccatttctaaggttatacagaagggaagcacgcctgcaggaatgcatctctcgatctgcgttaaagaaatcctggatttcctcaagatacagccggggcagaccggcctggatgcaacgcttgggtatggcggccatacgcaaaagatgctggaatgcctgcagtcggaaggccatctgtatgcgctggatgtagatcctattgaatccgaaaagacaaaggagaggcttcaaacgcttgggtatgggccggatatcctgacggtgatgcttcagaactttgccgacatcgaccaggtagcggaagagatggggaaatttgatttcgtgctggctgatctgggcgtctcttccatgcagatcgataatcctgaccggggattcagctataagacggaagggcctctggatctgcgtatgaatcccaagaagggcataagcgctgcgcagaggcttaaggatatatcggtcgaagaattccaggggatgcttatggaaaatgccgatgagccatatgcgcaggagatagcctgggaagtgacggaccgtcttcgcagaggagaagagatcgcgacaactacccagctgcgccaggcaatcgaagcagccttgtcctttattccggagaaggaacgcagggaggcagtgaagaagtcgagccagagaaccttccaggcgctcaggattgacgtgaacaatgagtatgaggctttatactcatttctggagaaactcccggaggtgctggcgccgaatgggcgggtggcaattctgacattccattccggggaggacagactggtcaaaaagtcttttaagcggttttacaaagaagggatttataaggaaatcgcaaatgatgttatacggccatcccaggaagaatgcatccggaatagccgggcgcgttcgacgaagatgagatgggcgatacgggcggattaagttcgcgcgggagcggcttgcagttaccgccgggaaacctgtaggcatttgtatactatgccacttaattgtgcgtactttgcacgaagagatggctctgctatgatggacgtatagaaaaatggcgaggagaaggtggcaggtatgatagatgacaaaagaagatcatcaagatatatagatgcagatcaggcggctgtccagttaaggaaagaaatcaggcgggcagatgccatagtaattggggcgggggcagggctttcggcctcagcaggcttttcttattccggagagcgtttttatgagcactttcaggactttgcggatcaatacggctttcgggatatgtatacagggggattctatccgtataagactttggaagaatactgggcctattggagccggtatattctcctgaaccggtatcaggaggcacgcaggccggtgtatcgccagctgctggaagttatcggggaaaaggattattttgttctgactaccaatgtggatcactgtttccagaaggcagggattgacaagcagcgcctgttctatacccagggagactatggattattccagtgctctaagccttgccacgacaagacctatgacaacgaggctgtcatccgggagatggcagagcggcaggaaaatatgaggattccatcagaactgatcccttattgccctatctgtggcaggccgatgtccatgaaccttcgcgcggatgcgagttttgtggaggatgatggctggcatcttgcagccgacagatacgccaggttcttgcgagagcacaagaggaatcgggtgctgttcctggaattgggggtgggatacaatacccccgggatcataaagttcagtttctggaaaatggctgcccagtggccggatgcggtatatgcctgcataaaccagggggaggcatatgttccggaagaactggccggaagatccatatgcgtggacggggatatcggggagatattgctgcgcctggaggagaaggaataaaatatagaggcatggcccaagattcgggccatgccttttatcgtgagtttttcatttcattttcttttcgtttttggtatgatgttattatctgctattttggaaggctattttttagagatgctctaagtcaagtattttatatgcatatacattattaaaggaggaaccattatggaaatggaaggtatgaagatagagacgatgaagataggggacaatgcggggattcccgctgtcgtatggggagaagcatccgaccgggtgattatcgccgtacatgggaacttgtcgaataaagcggatgctcccatccgccatcttgctgtgcatgcgctgccaaggggatatcaggttctgagttttgatctgcctgagcatggagaccgaaaggaagagcccactccatgcaagatccagtactgcgtggaggatctgaaagtgatcatggcatatgcaagatccagatggaagaagatcagcctgtttgccaatagcatgggcgcttttttcagccttctgacttatccgaaggagccgattgagaaggcactgtttttatcgccggtggtggatatgatgcgcgtgatagaaaatatgatggcccgatttggcgtgacgcaggaacggctgaagaaagagcagactatcgtgtccccggacgggcagaagatgtactgggattattactgctatgtaaaggaacattccgtaggagaatggaaggttcccacatatctgctatacggaagtcaggatagcatgtgcgagagtgatacgatatataagtttgcagaacgatattcctgtgatctggagattgtggatggggcagagcactttttccatacagatgaacagatgcaggcgctggacacgtggctttgcagatgcctgtaggggaagataaagaaagcatcaacaggcagaatactgcccgttgatgcaagccttcttatcgcataaactgattgattacatgaagcacgccgtcttcgtcgttggactttgtgacaaaatccgccttttccaatacggcgggctgtgcattggccatggcgacgccaagtccggccgtctcgatcatggtgatatcgttgtatccgtcaccgcagcagatcatctcgtccgccgtaaggccgctgctggtcaaaaggcggagaagcgaatgggccttatcgatgccaggaggcatgatctccagaaagaatggatcggagcagtatacgcttaaataagagcggaaatgggcgatgatctccttctgaatcttgcttatgacagcaggatcgccagtaatcaggaacttgttcggcgcttctttaatatgagaaaggaagtcgtcagcccggataatgggcatatggttgatgcgcgattccagttccgtatattgattagggcagatgccggagatcagcgcgtccggcgtataggtgacaagatccagcccctgatccttatattccaggaccatgtcatagatgggcttggcgcagtccatcggaagcgtcttgttgtatatgatttctttggtctggcagttggtaatgcgccctccgttgaaggagagaatgtaactgccgtaatctccaaggtgaagctgctcggcaagaggggccacgccattggtggggcgcccgcttgccagaactactttctttccctgttcttgtatttcgatcaatgcctttaatgttggctctgatatctctttgcttgagttggtaagtgttccgtccagatccagtgccagaatctgataattcataattgtactcctgtaatatatttatctatatattttatccgtatattttatctgtatattttcgttctaagtatcttcgttctatatatttttcagcgcttcgacgatcggtgtcagatccatgccatgggaggctttgaccagtacgttgtcgccgtctttaatgagatctttcatgacatccaggaagtctgctttgttctcgaaccaaagtccctgggtagaagaaccgtttgtggcgccgtccaccagttcctttgccaggtggccgatcccgcataccaggtcgatgccgtgggcagcagcgtattcccctacttcccggtgaagttctttctcgttatttccaagctcgcccatgttgccaaggacggcaacttttcgtccgatggccatatccagcacgtcgatcgctgccttcatggataccggattggcattgtagcagtcatccaggatgatcaggcgatccgtcttgatgatattgttgcgtcccgggatggagggaagtccttcgattccggccttaatctcttcggaagtgagatgaagagtataaccgactgccgcgcctgccaacgcattagagatcatgtgggcgcctggcagtggaacgacgcattcaaaggaggattcatccggcagatggatcgtgcaggaggttcctctaagtcccaggggctggatattgtcagcatagaactggcaattctctccaagtccgaaaaggataggagtggcgcctttgatcgggccaacctgcgagagcaggtcatcgtccccgtttaatatgatcgttccgccatccttcatatcctggatcatctttgatttttcctggagaatgccttcgcgggtcttaaagaattccaggtgcgcaacgccgatattagtaatgacgcagatatccgggctggcaacggaggagagacggcgcatctcgccgaaatggttgacgcccatctccagtatggctacctgatgatcttcgttcatttcaaagattgtgagaggaagcccccattcgttattgaagttgccgatggtcttgtgtacctgatatttctgggcgactacagaagcgatcatctctttggtgcttgtctttcccacgcttccggtaattcccacaaccttgatgtcaaaagaatcccggtacagcttggcaatatcaagaagcgcttgtccagtggattccaccaggatgtaagagaaatccgtatctcccaggtcttcgtgggagatgacgcataatgcgcccttttctatagtatcaggaatgaactgatgtgcgttgacattctcgccgtctattgcgacgaacagataatctttctgtaccttccggctatcgatcactacgccttccacttccatgcccagtttgctttcgtctccgtgatagacgcctttacaggctttggtaatgttttccagggtaaggttcttcattttccttgtcctccttattttgtgaaaatacgaccaggcctctgccccaggggcaaagacctgacagtttctagtcttggtagcgtgttttcatggattcttcaataattaactcgcacaggtcgccataatcaaccccgatggctctggctgatttgggaatcaagctggccggagtcatgcctggcaggccgttcatttccagacagtagaactttccatccgtctcatcgacaatgaagtcggcgcgggcatagacatccatgtgcagcacccggaaagctttctcgccggcgcgctggatctttgcctgggtcttatcatccagggatactggaggacagagttcctgagcgccgccgtcctgatacttattctcgtaattgaagattccgtcttttggaatgatctcgatcagcggaagggcctttcctgcgacgatgctgcaggcatactcccgccctttgatataaggctcgatgacgacttcgtcttcgcgatttacatcgaaggagcagcggatggcctcccggtattcctcttctgtatgaacaatatataccccgatgctggaaccgccggaacatggctttatgacaagcggcaggtagtagcccagcttctcaaggggagtatccttggtgtcacggttcagggaagtgcctcttggcgtaggcacgccggaacgcttgaagatctgcttggcaaccagtttatccatggacagggcacagccaaaggaattaggtcctgtatacttgattccaagaatatcgaaggttgcctggagtttcccgttttctccaacagagccgtgaagccccatgaatgttatgtcagcaatacggcatagatcgataacattcgggccaaggtaacagttggactggtccgggcgcgaagccttcagcgcttctaagtcaggcgtggtagtcttgatgccatctgcgatctcgagcccgccgccaggcaggtcgaatacctcttccagcttatcgggatcataaggtaatccgaagaacacatccagcagatacgccttgtgccctttttctctcagagttctgcaaatcccggcgcctgatatgagcgacacgtcgcgttcagggctgagtccgcctgctaatacaataattctcataaaaaatagtctccttctagtctgtcatgctcatttgatccaacaaggatttcttcacttcataaagcttaggggatagatccacgtatacttgatgcggatagaagagacgcttggtctcatcccacagtgtcttcttttcattcctgcagtattcggcgatctccattactgacggagacttgtatatgcacgctccattcttgaataccggtaccagaatctcgcgcatggtataagagccgcccgggagcttcgtctttttccaagtctcgatgggatcgaagagaagcatatcctcatccgtgttaaatgtctctcctacgaagcagatcaagtcagcttttactttgcctgttgttttatcatatatccgatagatggttttgttaccaggattggtaattttttctgtattttccgatatctttatcttaggctcgaatgtgttatcctcctctgactggatggcggcaagcttgtatacgccgccgaaagaagggcagtccttggaagtgatcaggtttgttccgacaccccaggaatcaatggcagcgccctgcatcttcaagtcatggagcaggtactcgtccagatcattcgaagcgcagatggatgcatcggcaaaccctgcctcgtcaagcatcttgcgggcttctttggaaagataggcaaggtcgccgctgtctaagcggatgccatacttcttaaatggctttccagcctctttaaactcctggaatacccggattgcatttgggactccagactttaatgtatcataggtatctaccagaagagtacagttatccggatacatatccgcataggtcttgaaagcagtatattcatccggaaaactcatgatccagctgtgtgcatgggttcccataaccggaacatcaaagagcttgcccgcaaggacattagaggttcctacacatccgccgatcatagcggcccttgctccgtacaggcctgcgtccggcccctgtgcccttcttaacccaaattccatgataccatcgccattggcggcaaataccacgcgggatgtcttggtggcgatcagagactgatggttgataatgttcaaaattgccgtctctaccagctgtgcttccatgatcggcgcaattaccttcagaagcggctctttcggaaagactaccgttccctcgggaatcgcatagatatctccgctgaaatggaacccgctcaagtaatgcaggaagtcttcgctgaagattcccaggcctcttaaatagtcaacgtcctcataggtaaagttcagattcttgatataatcaatgacctgatcaagcccggcgcaaacggaatagccgttgttgcagggattctggcggaagaatacatcgaagatgaccttctcgttctgtccctttgcgtaatatccttgcatcattgttaattcatacaagtctgtcagcaaagttagatcttgtctgttcatttctctttaatactcctttttatctggcagtgtaaccaactgcattataatatgaatataaattccgttatattatagcacttgaacggtaaaatgtaaaagaaaaaagtagtccttgtcgaacagtccgattcatactataataatagaacaagtgttaattatgaaagaaaataaggaggagtcggaaatgaccccagtttatgaagtaaggacaaagcatacagagcaagtcctgaaagattttatctcatttaaagaagctgaaaggaatgcgcatattactttccgtatcgtgatgcttggcatctgcgacgttaccctggcgtatctgggaaagggatctgcgctgacctatatattcgggatcctggcagtcctgacattcgcgtttgcgctggcaagaaagcccatcggcgtacgcaggcttgctaaggcagataagaactatcagaaccagagcgagatacattttatctttggagagagcgagtttcggatagagaatccggatgcaggggagccgcagcgggttaagtatggagaagtggcgttcatgtatacggataacaagtactattatattaatgttaacaacgaagacatgcatatgattcctaagggggatttcacgcttgggagttcagaagggttctatgattttatcatggacaagacaggaaagcagttaaagcctttgaaacttacctggaagatgaagaccaacatactgaagcaggcatggatggaagtccagagccagaagaatacagataagaaataggacaagatggcaaagaaccaggcgcttatacaagcgcctggttctttttgattgtctctaatatgatattctggcaatagtccccaatatgcttgcgtgtctccttgtcgagatcgtttggatagatcggctttccatattccagaattacatgcgtcttcttaatccgcggaaactgcttctcgaagatggagatcgtattgttcatgcacataggaacaattgcgcatccagtcttctcggcaatcttaaaggagccattgtggaagggaaggatgctaagttcctcgccgtcattcctggtgccctccggaaagatacagatagatatgcctttcttgacgtagtcaatggctgtcaggatggtcttaaggccctcctttggattatccctgtccaggaagaggcagtacagccgcttcatccagtcgcgcagaaggggatacttaagcatctcctttttggcaatatagcctgtcagcctggcgcagcgggagtaagtaagcagaatatcaaaataactcctatgattgccgatgaaaagtaccggctcatccggaatgttttcttccccgatcacggtcacctctacgccggataccttgagcattactttaaaagcccactgcaccagccgaaggctctgataatcgcaggccttcttattgaacttcccaatcagccactcgaccccgagcacggggattccaagaaccagataaaggcctaagaatagggccacaattataaatctaatcatccgtataacctctcaattcagatattttagtcgtagcataattatcctccatgcggagaaagatgtaaagtgcaaaactaatatttctcaggttttcggaagaaagtcttctgaaggaagcccatcagcctcatgctcaggagaaattcagtcattccgcctttctggcggtgacgtgcggatgtctcaaccagggcgtcgaccaccttctccgtgcgatcccgcagttccccggtcagatgcgcggtcaggggctctgtagccagggtcagttccgagaaatggtagtaaggattggctgccatatataggaaggtgtcgtaactgaagcggcactgttctaccttcatgggttcgtcttctggcaggaactggaaataatggtaagctcccagacacataagcgtgccccggcttaccggatattcccgggtgttgactacgatcttgccgttactgtcacggaaatacagcagggtgatgccgctgttcttctttaagaccgtctgcgatgtgacgatcttgcttacggcagtcacgggaaactggaagtcctctttggagtagtatttcgcgcttgcaaaaagcggcggataattgatggagtttttggactttgtcattggttttcacctccccggtagagactccggtattcgccaggcgtcatcttatagagtttgttaaaggccctggaaaaggagcggctgcagttgaaccctacatttaccgccacatccagcaccggaagattcgtcgtaagcagaagggctgcagcatgacgcagccttgtaaggacggtgatgtccttgtaggacgcgccgaatttctcctggaccagttcccggataacgctctcggacagatagagggatttggaggtatccttgatgtcgatgggagatgaaaaacttgcataggagtgattcagcacatccatcagcatctggctcatgatcatgccgcggtataccttctccccgctctccagcatctgcttgcgatattccagaggtgtcgtcccggtatatttcttaaagatgcggtagaaggctacttccgaggaaaatccggaatgctcggccacgtatgacagagacatgtcttcgtagagaagcgcgccggaagcgatattcacccgtacgcggttcagtgtgtgggcaaagttgtagccgctgatattgcgcagttcccggttcagcgtagaagcgttggtagaaaaacgctcagccacgctctcggccgtaatgtcctcggcaaaatgggagccgatataaagggttgcctgccatccaagaggccagtccttgtcctggtctttctggctttgatggatgccatgcttgatgaaaaagtacgcaaactgcccaaggatggagacctttatcagtgaactgccaggatcgaagcaggaatcttccttttcaaattcatcgaataaatcccggatcttttgctgatatactccttccagccggataacggggagggcgaccataatggcgtccaccgtatcagggcttggttccctgagcgccagaaaggaagagagcggatagtcatacacgcagatagacaactcaagaggatcgtcggaatccgctttgatcgtgaacgtgtggtacgactgaagccagacgaaggtactctgttcaaatgggaactctacgccattgatcgtaattgtgccgcatccggaattcaccagtatgaaaagggactcattttcacagatgggcggggtgatgtcgctgatggtatgcttctgcaggcgcagatatttgtcctttccggtaaagacagaatggacagggctgccacagatgggcttggattttattgtgtttggcatggtaatgctccttccttaactaggcgagtctgaaaattatgttagaagttataaatctgatagtattatagcacattttgtcccttaatcaattagatattaccaacaaaaagtaatctttactattgtaagatgccacgaaattatccgatattgtaccaggcaaaaatgttaaagttatatcaagcaaaagaagaaaatgttgaaaaaatgtacaaatagcacgaagaaaagatattaagcattaagaaaatgcacaaaaaatcagcgtgtgagagggagggcaaggagttgaagcgtgacttttttaacaagtttaatttggggacatcgaactttgtcacgccgggaaaacagttggaatacgtttcggaatgcaagccagattctactgcggtcatttgcttagataaagaacagaactgttccgttattacttggcatcagctgcacgtctattccagccagctggcatggtaccttatagaaaatgagattggcccggggtcgatcgtacttacaatgtttccgaacagcatcgagcacattattgcggtatttgcaatctggaaggcgggcgcctgctatatgcccatgtcctataaggcggcggaatccgagatcagggaggcctgcgataccatccacccgaatgcggcttttgcggaatgcaagattccaggattaaaattctgccttagcgcagacgagatatatgaggcgatggaaggaagatccaaggagatgccttcggaccgtctggccaatccgaacatgatatccttatcaggcggaaccagcggaaagatgaagttcatccgtcagaaccttccatgcgggctggacgatgagacgatcagaagctggtctttgatgtctggaatgggatttgagcagcgccagctgctggtaggcccgctgtttcatggcgcgcctcactccgcggcgtttaatggactgttcatgggcaacaccctggtactgaccaggaacctttgcccgggaaatatcctgaacatgattaagaaatataagattgaatttatacagatggtgccgaccctgatgaaccggcttgccaaactggagggagtcggaaaagaagactttgcatccctgaaggcgctgtgccatacagggggcgtctgttctccctggcttaagcagatctggatcgacctgctggggcctgaaaagatctatgagatgtattccatgacggaatgcatcggccttacctgcatccggggagacgagtgggtgaagcatccgggaagcatcggacggccagtgggcgatagcaaggtgtctatccgggatgagaatggcaaggaagttgcgccttttgagattggcgagatctatatgacagcgccggcctcctatctggttaccgagtacatcaattgggaaccgctggaagtgaaagagggaggcttccgaagcgtaggggatatcggctacgtggatgagcagggctatctgtacttttctgaccggcgcagcgacatgctggtatcaggcggagaaaacgtgttcgccaccgaagtcgagacggcgcttttgagatataaggatatcctggacgctgtagtggtagggataccggatgaagatctggggcgaaggctccatgcggtcattgagacagggaaagagataccggcagaggaactgaaaacattcctgagaaagtatctgactccatataagataccaaagacgttcgagttcgtaaggagcatacgaaggggagacaatggaaaggccgacaggaagcggatcctggaagattgtattgcccgcgggggatgattctataaatgcaaagaaaacaaattatataaaggaggagtaacaaaatgagttacgaagcacttttttcaccattcaaggtcagaggactggaacttaaaaaccgtatcgtcctgcctggaatgaacaccaagatggcaaagaacaagcacgacataggcgaggatatgatagcctaccatgttgccagggcaaaagcgggatgcgcgttaaatatatttgaatgcgtagcattatgtccggcgcctcacgcttatatgtatatggggctttatacggaccatcatgtagaacagcttaagaaattgacggatgcagtccatgaagcaggcggcaagatgggcatccagctgtggcatggaggattcagcccgcagatgttctttgacgagaccaacaccctggaaactccggacactcttacggtagagaggattcatgagatcgtagaagaattcggacgcggcgcaaggatggctgttcaggctggatttgacgcagtagaattccatgcggctcacagttatctgcctcacgagttcttaagccctggaatgaacaaacgtacggatgagtacggcggaagttttgagaaccgctgcagattctgttatgaagtcgttcaggcaatccgttccaatatcccggatgacatgccattctttatgcgtgcagactgcatcgacgaattaatggaacagaccatgacagaggaagagatcgttacatttatcaataagtgcgcagaacttggcgtggatgtggcagacctttcccgtggaaacgcgacttcattcgcaaccgtatatgaagttccgccattcaacctggctcatggcttcaacatagagaatatttacaacatcaaaaagcagatcaatatcccggttatgggagttggccgtatcaatacaggagagatggcaaacaaggtcattgaagaaggcaagtttgacctggtaggcatcggacgcgcccagcttgcagatccaaactggatcaccaaagtaagagaaggcaaagaagacctgatccgccactgtatcggatgtgaccagggatgctatgacgcagtcatcaatccaaagatgaagcatatcacctgcacccacaatccaggattgtgcttagagtatcagggaatgccaaagacagacgctcctaagaaagtcatgatcgtaggaggcggaatggcaggcatgatcgctgcggaagtattaaagaccagaggccataacccggtaatcttcgaggcatccgacaagcttgcaggacagttcaggctggcaggcgtagcgccgatgaagcaggattgggcagatgttgcagaatgggaagcaaaagaagtagagcgccttggaatcgaagtacgtctgaataccgaagtgactgcagagaccatcaaggaattcaatccggataatgtcatcatcgcagtaggctctacctatgcgctgcctgagattccgggaatcgacagcccaagcgtatactcccagtatcaggtactgaaaggggaagtaaatccgacaggccgtgtagccgttatcggatgcggactggttggtacggaagtcgcagaacttctggcatccagaggcgcacaggtaatcgcgatcgagaggaagggcgtaggtaccggccttagcatgcttcgcagaatgttcatgaacccggaattcaaatattacaagatcgccaagatgtccggaacaaatgtcaccgctttagagcagggcaaggttcactacatcatgacagacaagaagaccaaagaagtgacgcagggagtcctggaatgcgacgctaccgttatctgtacaggaattaccgcacgtccaagcgatgggcttaaggcaagatgcgaagaacttggaatcccggttgaggtgatcggagacgctgctggcgcaagagactgcacgatcgcgacacgcgaaggctatgacgcaggaatggcaatctagaaaatcagaacttatcaatcttacatatagaaaggatgatacatatgacattagaagagagagttgaagcattagaaaaagaattgcaggagatgaaggatattgaggcaatcaaggaactgaaaggaaagtatttccgctgcctggacggaaagatgtgggatgagctggagaccaccctgtcaccaaatatcgtaacctcttattccaacgggaaactggtattccatagcccgaaggaagttaccgattacttaaagagcacgatgccaaaagaagagatcagcatgcatatgggccacacgccggagatcaccattgacagcgagactacggctacgggcagatggtatctggaagatagactgatctttacggacggtaagtacaaagacgtaggaatcaatggcggcgcgttctatacagacaaatatgagaagatagacggccagtggtacatccttgaaaccggctatgtacgaatctatgaagaacatttcatgcgtgatccaaagatccatatcacgatgaacatgcacaaataagaatattgtaaaagaaaggcaggagtaagagtatgaatctcgtacaagacaaagttacgatcatcacaggcggcacaagaggtattggattcgccgctgccaaaatatttatcgacaatggcgcaaaagtatccatcttcggagagacgcaggaagaagtagatacagcgcttgcacagttaaaagaactttatccggaagaagaggttctgggattcgcgccggatcttacatccagagacgcagttatggcagcggtaggccaggtagcacagaaatatggcagactggatgtcatgatcaacaatgcaggaattaccagcaacaacgtattctccagagtgtctgaagaagagttcaagcatattatggacatcaacgtaacaggcgtattcaacggcgcatggtgcgcataccagtgcatgaaggatgccaaaaagggcgttatcatcaacacggcatccgttacaggcatcttcggatcactctcaggcgtaggatatccggccagcaaggcaagcgtgatcggactcacccatggacttggaagagagatcatccgcaagaatatccgtgtagtaggagtggctcctggagttgtgaacacggatatgaccaatggcaatcctccggagatcatggaaggatatctgaaggcgcttccgatgaagagaatgcttgagccggaagagatcgctaatgtatacctgttcctggcatctgacttggcaagcggcattacggctactacggtcagcgtagacggggcttacagaccataattttaatttttactaagtagaatatgtgatatagaaaaggagatataaaaacatggctggaataaaagattttccaaaattcggagctcttgcagggcttaagatacttgacagcggatctaacatcgccggacctttaggcggaggccttctggcagaatgcggagcaacggtcatccattttgaaggaccaaagaaacctgataaccagagaggatggtacggctatccacagaatcaccgtaatcagctgtctatggtagcagacatcaaatctgaagaaggaagaaagatcttccttgatctgatcaaatgggcagatatctgggtagagtcatccaaaggcggacagtatgacaggctgggactttccgatgaagtcatctgggaagtaaatcctaagattgccatcgtgcacgtatccggatatggacagacaggagacccgtcttacgttacacgtgcatcctatgacgcagtaggccaggcattcagcggctatatgtcactgaacggaacaacggaagcgctgaagatcaatccttatctgagcgatttcgtatgcggacttaccacatgctgggctatgcttgcctgctatgtaagcaccattcttaccggaaaaggcgaatctgttgacgttgcacagtacgaagcgctggcacgtatcatggacggacgtatgatccagtacgctacagacggcgtgaagatgccaagaaccggcaataaggatgcgcaggctgccctgttcagcttctacacctgtaaagacggacgtacgatctttatcggaatgactggcgcggaagtatgtaagagaggcttcccgatcatcggacttccggtacctggaaccggagacccggacttcccggaaggcttcacaggctggatgatctatactcctgtaggacagagaatggaaaaggctatggagaagtatgtatctgagcatacgatggaagaagtagaggctgagatgcaggcacaccagattccatgccagagagtatacgagctggaagactgcctgaacgatcctcactggaaagcacgtggaactattacggagtgggatgacccgatgatgggacatatcacaggccttggactgatcaacaagttcaagagaaatccttccgaaatctggagaggcgctccgctgttcggtatggataaccgcgatatcctgaaagacctgggatatgacgatgcaaagatcgatgaactctatgagcagggcatcgtcaatgaattcgaccttgacactactatcaaacgctatagactggatgaagtaattccacatatgagaaagaaagaggagtaagagtatgagcaccgtagccaatccaaattataagaaaggttttgtcccctttgcaattgcagcactcctggtgagcctgatcggcggttttaccgccgttctcggcccggccttcgtggcggaccaggggattgactataataataccacatggatttccctggcgctggcgatgtcttccgccgcatgcgctccaatccttggaaaactgggagacgtgctaggacgcaggacgacgctgcttctgggtattgtgatctttgcggccggcaatgtgctgacagccgtagccacgtccctgatattcatgctggcagcccgttttatcgtaggtatcggaacagcagcgatctcaccgatcgttatggcctatatcgtaaccgagtatccgcaggaggagacaggaaaggcctttggcctgtatatgctgatctccagcggcgccgtcgtggtaggacctacctgtggcggcctgatcatgaatgcggctggctggagagtcatgatgtgggtatgcgtcgctctgtgcgtcgttgtattcctgatctgcacattctccatcaagaagactgcatttgagaagaagagcatggcaggatttgacaagccgggcgcagccctggtagtcgtattcttcagtttgttcctgtgcatcccatccttcggacagaatatcggatggtcttccacagcatttatcgcagcagcggcagtagcgctggtagcacttttcatcctggtaatggtagaaaagaaagcgaagagtccgatcatgaacggcaagtttatggcacgcaaggaattcgtgcttccagtattgatcctgttccttacacagggacttatgatggcaaatatgaccaatgtcatcgtgttcgtgcgctatacgcagccggacaatgtcattatatcaagttttgcgatctccatcatgtacataggaatgtccttaggctccgttatcattggacctgttgcagataagaaagagccaaagacggttctgacattctctctggtactgacagccatcggctgtgcgctgatgtatctgttcaaggcagattcctccgtcgctatctttgcggcatccttgggaatccttggatttggccttggaggaaatgcaaccatcttcatgaaggtagcgctttccggcctgtccagcgaagtagctggctctggtactggaacctatggcctgttcagagatatctcggcaccattcggcgtggcagtgttcgtgcctatgtttgccaacggcgtaacagcgaatattgcgaaatacgcgtcaggcggcatggaagaaggcgccgctacggtaaaagcagccatctcatccatccagacgctgacactggttgaacttggatgtatcgttgtgggaatcatccttgtgagaatgctgccaagaatctatcagaagaaagaggcataaataagttaagaaaagaggtaattataaatggatatgaaacattccagattattttcgccgcttcagatcggatccctgacactgtctaaccgtgtcggcatggctcccatgagcatggactatgaagcagcagacggaactgtgcccaagaggctggcggacgtatttgtccgccgcgccgagggaggcacaggctacgtcatgatcgacgcggtgacgatagacagcaagtatccttatatgggaaatacaacggcccttgaccgtgatgaactggttccccagtttaaggaatttgctgacagagtaaaagaagcaggcagcacgctggtgccgcagatcattcatccgggtccggaatccgtatgcggctaccggcatatcgctccgcttggaccttctgccaacaccaatgcaaactgccacgtgagcagatcgatcagcatagatgagatccatgacatcattaagcagttcggccaggcggcacgccgcgccgaagaagcaggatgcggggcaatctccctgcactgcgcgcatgcgtatatgctgccaggatccttcctgtcaccgcttcgcaacaagcgcatggatgaatatggcggaagccttgacaaccgtgcccgtttcgtgatcgagatgattgaggaggcccgcaggaatgtgagtcctgatttcccgatcttccttcgtatctccggagacgagagaatggtaggaggcaacagccttgaagatatgctctacctggcaccgaagttcgaggctgccggcgtaagcatgctggaagtatccggcggaacccagtatgaaggcctggaacatatcattccttgccagaataagagcaggggcgtcaatgtatatgaagcttctgagatcaagaaagtagtgggcatcccggtatacgcagtaggaaagatcaacgatatacgctatgcggcagagatcgtagaacgcggcctggtagacggcgtggctatgggacgtccgcttctggcagatccggacctttgcaagaaggcagtggaaggccagtttgacgagatcactccatgcgcaagctgcggcggaagctgcatcagccgttctgaggcagcgcctgagtgccattgccatattaatccaaggcttggccgggagtatgaattcccggatgtgcctgccgagaagtccaagaaggtactggttatcggcgcaggccctggaggaatgatggctgccgtgacagctgcggaacgcggccatgatgttacggtatgggaggctgacgacaagatcggcggccagctgaacctggcagtagtggctcctggcaagcaggagatgacccagtggatggtacatctgaactatcgcgcgaagaaagcaggcgtgaagtttgaattcaataaagaagcgacggcagaagatgtcaaggcgctggcgccggaagcagtgatcgttgctacaggcgcgaagccgctggttcctccgattaaaggaacacaggattatccggtgcttactgcccatgatttccttcgcggcaagttcgtgattccgaagggacgcgtctgcgtgctgggaggaggcgcggttgcctgcgagactgccgagacagtcctggagaatgcacgtccgaattcttataccagaggatacgatgcaagcatcggagatatcgatgtcacgcttgtggagatgcttccgcagctccttaccggcgtatgcgcgccgaaccgcgagcctttgatccgcaagttaaagagcaagggcgtacacatcaacgtcaataccaagatcatggaagtaacagaccatgaagtaaaggttcagagacaggatggaacgcaggaatggctggaaggatttgactatgtcctctttggccttggttccagaaattacgatccgctttcagagaccctcaaggaattcgttccggaagtacatgtcatcggcgatgccgtaagggcgcgccaggcaagctacgcaatgtgggaaggatttgagaaggcatacagcctgtaaaagcggtttgagtaaaaggaggcttaagaaatggcagtgaaggcaatctcaggctgcgacaaggatcaggaactgatcattgataccttgaagcatgccagaaggcaggagtacacgccccaaaggctgtgcgagcttcagaagatcattgagacccagtattattactggtggatcatggatatgaagaaagaagaattctgcctggaactgttcgatgaagacttccaatactactataatggctatctggcatcaactaagccagaagaacaggccaggacatccaaatgggtcaatgcgcctctggcaacgatgcatatgggccatcagcctctcgtatggctcatggacgagaaaaatgccagaggaatcttccagtatgaggaccaccaggtctatcgggaaagcggcgaagtcgtggagacatggatggtatactgtaatgatttctgcaaggatgaaaaaggaatctggcacatcaagacgatgcgtatgatcaagcggcaagctgacggccgctaccatgacatcaatccaccagaaggctggaagccagaagagtgggatacatgtgatttttaaaaaaggagacaggatgaatcttcggggagatatcatcctgtcttttgctatcctcttccatataataatgtaagttcttttaattcctcggcaagggcagggcttaaagcgtcctttttaaagcgccagctccaattgtcagaagccgtgccaggaatgttcatgcgggccgtcgagccatagcccagcagatcctgcagcggaaagatactgtagcgggcaatgctcccaaggcaggtacggatcaggcagcggctaatctgcgacgcgtccttgcagcaggtatagcgtcgcaccttttcctgacagtcggccggaagatgctggtaccagccggaagtggtgtcgttgtcgtgggtacctgtgtagcagacgcagtccggcgaagtaaactgatgcggaaggtagctgctctctaaagtggaatcaaaagcgaactgaagcaccttcattcccgggaaatggaaatgttctcgcagcgcattgacctcatcggtgatgatgcccagatcttcggcgataataggaagatcgtctcccagggcattctggatggcattaaagagttcatagccaggagcctgcacccattgcccgttgatggcggtcttctccccgtattccaccgaccagtaggcctcaaacccgcggaaatgatcgatccggaggatatcaaggacatccagctggtgccggattctggagatccaccaggcaaagccttcttccttatgggcatcccaggcatacagcggattaccccacagttgtccggtggcagagaagtaatccggcgggaccccggccaccttgaggggatagccgtcagaatccagctggaagagatgctggctggcccatacgtctgcgctgtccatggaaacaaatatgggaatatccccgataatccggatatccttttgattggcatattctttcaggcgcatccattcatcaaagaacaagaactgcgtaaattggtagaagccaatggcctgtgacaggcggcttcgaagctgctcttttctgtcttccgtgggagtgcggtattgctcatcccattccagccagctgcgcccttcatttcgttccttgcatgccatgaacagagcatagtcattaagccagtagccttgttcctggacgaacctgtaaaagccttccttcaatttttgattatcatagccatctctgaggaattcctgatatgctgcttccaggatatgctgcttccaggggatcagtgttccatagtctacgcgctcatcatcggaagcagggcagtcctccagatccttatctcctacaagtcccagacgctttaagacggaagggctgatcaagaggggctgtccggcaaaggcagaaaaactctggtaaggcgagtctccatatccggtgtgcgtaagcggcaggatctgccagagatgctggcctgccgctgcaagaaagtctacgaattcgtgggcagcctctccaagatccccaatcccatagggcgatggcagcgaagtcggatgcagcaggatgccggagagtctttttttatctttcatgagtttcctccttctatactattttcatacgaatagacctcattatactacaaatttggtatttttcctagcattgctgtgtatgatgttaaagagaatatgctcttatgagggattctatgaagaaacgatggggaatactgctgctggccttttgtcttcttggcctgacggcgtgcgccgcaggaaagctggacacggagaagatacgggatattgaattcacggttctttccaaagaggaggtgccggaggaattcatgacacagatagaagaagaaaagagcggtcagatgaagctaaactatggggataaaggatacctgtacatagccagaggatacggaaccaagaagaccaccggctatagcgtggaagtttcccaatgctatgagaccgggaattcagtcgtcctaaagaccggccttcaagggcccggaaaaaaagaggagattcttaagaagaagacctatccttacgtggtaataaagatggagtatacagataaacaagtagtatttaagtaggaggcgcagatatggaatatgtaacaaagcagatgcagacttacaggactggcaagaccatcacggaccagttctacattgatgacgattataatgtaccggacgcgaaaagcgatgtgaagagagtcatacttggcgagggaacgctggcggttgaggatatgaagattgtggaaaattatatccgggtggccggcaagctgaactttaaggtgctttatgtgacggatgagggggagacacgcctgtcctgcctggagggacggattccatttgaagagatgatctatctggagcaagatccagtgggggatctgttcatccagtcctcaagcgtagatctgaccgtcacggccattcattccagaaaattaaatcttaagaccctggctgagatatccatctgctccgaaggacgcaaggaagcggagatcactacggacattgacagtgatacgcccctttataagcggcatgagagcaaggaactgcttcgggtattcaccacgaaaaaggatacataccgcattaaggaagaggtgtccatcggcggaacgaaggagaatatcggcacgcttctgtggacggaggtcaatagcaggaaactggatacgaggcttgaggcggatgaactgaaacttcagggcgaactgctgcttttctgtttctatgagtctctggatggcaagacggactggattgaacagacaattccatatgaaggacgtatagaatgctatggagtacaggataatatgtatcaccagatatatccggaacttacggatgtgaacatcgacgtgcggatggatgaggatggagaaatgcgcctgatcggagtagaggcgaccctggaagtacggctgatcatatatgaagaagagcaggttgatatcctgtcggacatctattccctggagcaggcgtgcactccaagagtgacagaagagtggatggagcagctcctgctgcagaatcactccaaatgcaaggtgacagagcagctctccctaccggagatcaaagatgatatcctgcagatctgccacagcagcgcccgaattcagatcgagcggacggaaccggcagacaatgggattcagattgagggcgtgctgcacatcagcttcttgtatgtaaaagcggatgataccataccttttgatacatggcaggggatgataccattttcctatctgcttgaaggcaacgagacttccgcggatatggtctatgggctgacttctgcggtggagcagctctctatagggcttctgggcagcgatgagattgagatcaaggccgttcttgcatttaacagcttcttgaagaagccagttcggatcatgaacatcgaggaagtggagtttgcgcctattgatatggaagaggtggaaagaaggcctggaattaccggctacatcgtgagagaaggcgacgcgctgtgggatcttgccaagagatacagcaccacggtagaaggaatcatggaggtaaacggactggaaaaagaggagataaaaccaggggataagatattgatttttaaggaaaatatgagtatactgtaggtacactgtatacaagatacaaggagaaaacatatggataaactggacttaaaagcactgggaaagataaatctgggactggatgtattgggaaagagagagaatggctaccatgacgtacgaatggtaatgcagacagtgtatctctatgaccagattcgcattgagaagaggaaggagacgggaatcagcctgtccaccaacctgttctacctgccggtcaatgagaataatctggcttatcgggcggccagcctgctgatggaggaattccagatcaaggagggcgtgaagatcaccctggataagcatattccagtggctgcagggatggctggaggaagctccaatgcagcagcagtcttatttggaatcaaccgtatgttttcgcttggactgtcacagaaagacctgatggaacgcgcagtgtcgctgggagccgatgtgccttattgtatcatgaggggaaccgtgctggcagaaggaatcggagagatcctgacgccccttccggatatgcccaaatgccatgtcctgctctccaagccgccgatcagcgtttctaccaagctagtttatgagaaactggattcttatgacagtattgaacatccggacattgatggaatcataaaggggctaaaagatggggatattaagaaggtagccgcgagcatgggcaatgtgctggaaaatgtaaccatagaggaacatccggtcatcgaagagattaagaacgtgatgcgcaaggaaggcgcgctaaatgccatgatgagcggaagcggccccactgtattcgggctgttcgaagacaagaagaaggccaagaaggctgctgccaggataaaggagttacaattagcgaagcaggcgtacgtgaccagcgtacataatgcaaggaggaaataaatgatggaaccgaactttaaagtgaatatgaatgagtacctgcctctacgggacgtggtgttcaatacgcttcgccaggcgatcctgcgaggcgagctaaagccgggcgagaggcttatggagatccagcttgccaataagctgggagttagccgcacgccgatcagggaggccatccgcaagctggagttagaaggccttgtcctgatgattccaagaaaaggggccgaggtggctgagattacagagaagagcctaagagacgtcctggaagtgcgaagagcgttggaagaactgtctgtacagctggcgtgcgaaaagatcaccaaagaagagatacgcgagctggaacgcgtggcaaaggagttccagcaggtagtaaagagcagcgatattaccgagatcgcggaagtggatgttcgtttccatgatattatctatacagcgacggataaccagaagctgatccagctccttaacaacctgcgtgagcagatgtatcgctaccgggtagagtatctgaagcgggacggcgtgtttccccagcttattgccgagcatgaggcgatcatccgtcatattgagaacaacgagaaagagaaggccacggaggtcatgtgcaggcatattgacaaccaggtagaggcggtgatcgacgtgatccgggcaaaacataactagcagttgaataaaaggcctttcatatgtcaagactcctaataacagtgaaggaggtacgttacatatggaaggaaagaaaaattatttggaaagatatagaatcagacagatcatctgtgttatacttggaatctgcattgccctggccgcaacgctgattcttaccgcaagccgcatgaagcaggtggacgcgaaggtcgcgcgtacccaggagtcgctggcgaaggaagtgttccgcttccatgtgctggccaacagcgacagcgacgaggatcaggcagtgaagctgaaggtgcgggacgcagtcattacttatatgaaggaaagcatggatgaagagatagaaggaagtacggatgcaaaggatacgaaggagtgggccaaggcccatctggaggaactggagcaggtagccgaccgcgtgatcaaaaaggaaggatattcctatcaggcggaggcggaagtgaccacctgctattttccggataagcgttacggagacatcctgtttccgcaaggagattacgaggcgctcaggattaagcttggaaaggcccaaggccataactggtggtgcgtcctgtatcccaatctgtgctttaccaattcaacctgtgccgtagtcagcgatgatgggaaagaagaactgaaagaagcgctgacggcagaagaatacgagatggttaccgctacctcggactttaagataaaatggttctttttcggagaggattccgaagaggattaggagaaacatggaggcagttttcatgactgaatttttagttagacattttgttaagaaccacgaagacgttgaaaaggtgtctgtccgcaccgcctatggagtattggcgagcgtggtgggcatcttttgcaacgttcttttgtttgtggtcaagggggctgtaggattcttcctgcacagcgtctctgtcatggcagatgcgttcaataatctgtcggacgccggctcttccgtcgtagggcttgtgggggtaaggatggccagcaagccggcggatgaggagcatccttttggccatggaaggattgaatatatagcggcgcttgtggtatcctttctggtactgcaggttggatttacattttttaaggattccatccgcaagatacagaacccggaagagttaaaattccaggcagtatccgtcatcatactggtgctgtccattggcgtgaaactgtggatgggcatgtttaataagaagcttgggaagaagattgattccaaagtgatgatggctacggctacggatgccatgggagacgttgtgacgacgaccgccaccatcgcgtccgttttatttttcaggattacgggaatcaatattgacggaatcgtaggaatcggcgtatccctggtggtaatgtgggccggaatcggcattgccaaagatactttggagccgctgatcggcgaggcagtggccccggaagagtatgtgaggatcagcagattcgtggaaaagtatgagggaatcgtggggagccatgacctgatcgtgcacaattacgggccaggaaggagcatggcatccatccacgcggaggtacccaatgacgtggacatcgaagtgtcccacgagatcatagaccggatcgagcgggatgcggccaagcgcctaggaatattcctggtaatacatatggatccggtggagacgaaggacgagcatgtgctggaggtgcggcatcaggtggaacagatattggatgcagtggactcacgcgtgtccatccatgatttccgcatggtggacggcaaagagcagatcaatctgatctttgatatggtggtgccctttgagtacagcacgcagaaacagaatgaactgaagatgacgcttcggaagctgcttcagatggcagataaaagataccagtgcgttatcaccattgaaaggagttatgtagcaagtgcaaagggataatcaatatacatttaaaagcagggtaagattcagcgaggtagatcacaccaaacggatcacgcttccaggaatcgtaaactacttccaggactgcagcacctttcagtcggaagggctgggactgggagtcgatcacttcgcaaagcataaaagggcgtggatcctgtccgcctggcaggtcgtgatcgacagatacccttccctgggggaagagatcagcgtcagcacctgggctaccgaattcaacggcctctatgggcttcgtaacttctgtatggaagatgaagggcagcagatgactgcctgcgccaactcggtatgggtctatatggatatagaaaagggaaggccggcaaagccgggagaagacgagacgaaggcatacggagaaggggagcctctcaagatggagtatgcgcccaggaagatcgcgcttccaaaggatgcagagcctatggatgcatttccggtaaggaaatatcatatcgataccaatgaacatgtcaacaactgtcagtatgtgcagatggctttggaagtgctgaaagaacggatggaagtacggcagctgcgggtagaatacaagagatcggccgtatatggggatgtcatctatccccggacagcgtatgaaaaagaccggacggtagtggaactgtgcgatgaagcaggaaagccctacgcagtcgtagaactaaagtaagggcaagggcttaagaaggaggaaagcatgacattagaagaaggattaggaacaaaaaagacgcttatggtggtaaaagaggtggaattcggcgtatacctggggaatagccaggagaaggtactactgccgaaaaagcaggtgccggaaggcgtggaggtgggagatccgatcgaagtattcctgtataaggattcttcggacaggttgatcgccaccaccaacgagccaaagatcatgctgggagaactggcagtacttaccgttgccgcgacgggaggaattggcgcatttctggactgggggctggagaaggatctgctgcttcccttccgggagcagacggcgccgcttaagaagggggaccagatcctggtagccctatatatcgacaagtcgcaaagactgtgcgccaccatgaaggtctacgaaaggctgcgtacggattctccttataaagtggatgaccaggtggaaggaatcatctatgagttaagcgataatttcggcgtattcgtagcagtagacaatctatattccgcgttgatacctaagagggaagcctttgggaagcttagagtgggagacagagtaaaagcaagggttgtaaaagtaaaagaggacggaaaattagatctcagcgtgagggagaaggcatttctgcagatggatgcggacgcggacttgatcatgaagcggatggaagaatatggcggaagcctgccttttaccgataaggcagacccggaactgatcaagaaggagtttgacttaagcaagaacgcgttcaagcgcgcaattggccgccttttaaaagagggaaagatagaaattcgtgaaaaaagcattgaaatccttaacaaatagtttataataaggggcgaaggattgaaaattggaaaggagattggtagaagatgaaagtacagaacatcacagacgtagataagttttttaaggtagttgaccagtgcaaaggcagggtcgagttagtaacaggcgagggagacaggctgaacttaaagtccaaactgtcccagtatgtgtctatggcgaatattttctctaatggagagattccggagttagagattattgcatatgagaaggaagatatcgacaagctggtgaactttatgatcaatggcgagtaacaggcctgggcttgacgatgatataagcagatagcagaaatgattgctgccaatggaagaattaatccattggcagtttttttgtctgctttttaaataatgaatgcttaagattactccggagactggaggacagaccaggtatctacagaggcggtaatcacttcatcgatacgtcccgcgtcctttgtctcaatgatatctacaatattcttgtgtaccttatagacaatgcctccatgctgatgcttatgcgttgccgtgatggatggctccataaagtctatgacgaaattatagatccgttccgccagcaggttgcaggacgccttcccgagcagccggtggaattccaggtcattttcccttaatttttccggatacgcgccgaacttcatcaacatgccaagctcatccagattatctttcagcgcccgtctttcacgctggttctcatcgtaatgcttcaatattaattccagaatattaatctcgaatatatggcggaattcgtaaatgtcgtcaatattcggattcacagtaaaaaaactgaacagaaaggaatccagaatgctgtttgccggagtctcgcatacataagtgccattgccgacacggatatcgatcaggccaaaggcagagagtattttcatggcttcccttacagagccgcggcttacccccaggccttcggatatttccagctcgctgggcagcttgtccccaggctttagccggcggtcgatcagcagctgcttaatattattgacgacaatgtcaactgcagattcgcgcttgctggctttctcatagaagatggacatggtttacctccgatgtttctattttcgatgtatctatatgtattaatctaccataaacaaagataaaacgtcaaatgatttattataatattatattgaaaatatgacaatattttacttataattcgaaaatatatgaaaaatgctaattatttgtctcgaaaaatgaaaagtattgacagattatacaaaatgtgatatacattaaacatcaaatgtttaattatatacaatagagaacaaagtagaaaaggactgtttcaaggaggagaaaaatgaagaaaaaaatcgtgagtattctactgtgcctgacgcttgtagcatgcatggcagcaggatgcggagaaaagaaggcagaagatggcggcaaaagcgaggcaaaaagcagtgagtccaagtcggatggagatgccgtggtcaaaaaaggagattatgtaatcggcctttcaaattcatactttggcaatacctggagaaagcagatggtagaagcatttaccaattcagccgaggaagccaaaaaagcaggatatatctctgactatgagatccagaatggggataatacggtgaattcccagattgcccagattaacagctttatattagaaggcgtggatgccatctgcatatgcgcggcatcgccaacggcgcttaacagtacgatccagaaggctttggacgctggtattacagtcgttgccttcgactctatcgtagacttggatggcgtatatacaatggactatccttgggagcagatcggcaaggacagcgtgaattatgttggagagcagctggatggcaaaggaaacgtggtagtcgtaaggggcgtctcaggcgctgctcctgaccagggaatatatgccggcatcacagaggcgatgaaagactatcctgatctaaagatcgtgcaggaagtgattggcgaggccagtgcaacaaagacccaggaagaactgacaaaggtcatggcttctcttcctgacgtggatgcagtaattacccactgcggcggcgatgccatcggcgcggtaaatgcatttgaccagtccggcaaagatatgcctatcattattggagataacacggcggaatatattaactggtggcttgagcaggacggatatgagactctcagccagggctccacgccaggctgcggcgcggctgcgttctggaccgcgctggatatcctcaacggatatgatgtaccggaagagatgatgttaagcgtaccacatataaccaaagacaatgtaggcgaatataaaggaatgaaggccggaaccttcgtatcacctgattttacaaacgaatacgtaatcgagaatatcattgacgcatctaaatagaaggacggtgaacgacttgagggaaatctttcttgaaggaaaagacctgttgaaggtgtatggccctacaacagccgttaatcatctggacatcaatgtctaccagggcgaggttctagccctggtaggcggaaatggtgccggaaagagcacgctgacaaagatactatcgggagtcattagcagcgactccggaagcattaagattcttggagaagagatcaatctgaataaatacacgcctgccacagcacgttcaaagggaatccgggtggtgcatcaggaactgtccttatgcaagaatctgacagtatacgaaaatttctatattgagcagtatcaaagatttcaaaaagggaacccaaagtggagagatgaagcgagagaaatggccaggcaggcgcttgaccgggtgttcccggatcacggaattgatgtaggggcaggacttgcgactttaagcattgcccagcagcagatggtggagatcgcaagggcaaccagcgatccggatgtcaagatgatggtgctggatgagccgacttcatctcttccggcaagacagacggaacagctgcaggattacatcaagaagagcgccagggaacagaagattgcctatatctacatatcccacagattgaaagagatcatgtttctggctgactatatatacattatgcagaatggggcccagaagtatcagtgccccataggcgagacggatgaagacgatattgtggagcgtatgggggatggagcggttgagaagaaggcagggatatttctggctcctgaactgaacaagaataccagggtgagttttcacgattattcttccaagcatttaaagaatgtgacaaaggaaatgtacggcggagagatcgttgctattaccggattagaaggcaatgggcagctggagctgatccaggagatcttttaccaggcaaagaagaaaaggcccgggcttcagatcagtggaaaagtagcttatgttgccggagacaggaagaaggaaggcatcttcccgctggggtcgatcaaagacaatatgattgtctccaagatcgcggattctgcgctgtttaagcccatatccatgggaaatgtagatcaggcggtcacgcactggaaccagaggctaaagacaaaatgcgcgtctaccgatgaccttatcacgatgctgagcgggggcaaccagcagaaggtgctgattggccgggcgctggctgtagatgcggatattattctgctggatgatccgacccggggcgtagatatcgggacgaagctggaattgtacgaagtattccgggaggcagccaaggcgggaaaactagtcatctggaagacctcggatgacgcggaactggaatattgcacccgcctgctggttatgaataatgggacaattgccggggagttcagccatgaagaatttgatcattcttccatgcttaaagtcgctttccgtaacaataaggagaaggcggacaacctggagaaaaggaaggccaagacacccaggctttatttattttcactgatttccatgcttgtcctgtatatggtctgcgggttcatgtctccttctattttctctaagttcggggttgaacttctggcggtaggctttgcgccattcgtgtttgcggccttggcccagacatttatcatcggccttgggcatatcgacttgggagtaggggcgttcatggggcttgtgaatgtcatctgcgccacgattctggatcagagcaccggccttgggcttctgtgcctggcaggcctgattattgcatactcctgcatgggactcgtgatatacctgcgggatgtgccgccaatcatcgtgaccttgggcatgtcttttgtatggacaggaatcgcatatgtgctgcaggacgttccagggggacatgttccggaatggatggtccatatatttaacttcaacaacccaattctgcagggcgtgctggtatggctggttctatttatcgtagcagcgatattcatataccgctccagatatggcacggctctccggggatttggaaacaatgagaatgcaatgcgcaacagcggatggtctaaggcgaaggcatactggaccacctacatgatcgcgggaacctttgcggccatggggggaattgcccagtctgtgatcacgggcgcatccgacgttaatgcatctgctacatataccatgctgaccgtggcagccgtaattatcgggggcggctacttctccggaggcgtggtgacgcatataggcgcggtattcggaggcatctcccttaccatgatcagcgtgcttctgggccttctgaaggtcagcacggattataccgcgacaatccaggggcttgtcctgattatcatattgtctttaagactgattagaaaggagaagctgcagtgatgaaaaaggtaaaaaaatatattcgagaaaataactggctgtgggcggcagcaggcgcctttctgctctggctgatcatgggtcttacgtccggcaggctgaatgtggagagtttcctttccaatgcgtatatcgcctcttttctggtcatcttgtcttttggacagatgctggtagtgacatccggacgaggcgccattgatttgtccatcccgggcgtacttacgctgatggcttttatatccatgagcattatggacggggaggataagaatgtccttccggcaattctggcagtgatcgcggtggccgcggtgatcggaatcctgaacgggcttatggtaatctatctccagataccggcaatcatcgccaccatggcaatgaactatatcctgaccacggcagccctcctgatcaataagaacttttccgtgttcgggacagcgccgatgctggataagctgatcaaggcaaggatatttggcgtacagctgatcatctttcttgtgatactattggcggtattgttctggttccttcttaatcgtacctcttatggcaagtcgctggtgaccatcgggcagaatagagaagcggcaggacttgcgggaatcaaggtgaataaggtggaaatacttacctatgtattcagcagcgttctggctgccataggtggcgtgctgatcgcggccagggtaggaaacgcgatcctgggaatgggggatgactataccttagagaccgtagcgagcatcgtcgtaggcggcacactaatatccggaggaaaggccaatgtcccaggcacgctggcaggctgccttttcctcgggctgatcgtgacggcaatgcagatcatgggcttttcagtgggagcgcagaatatagccaaaggcgcgctgattatcgtggtgcttctgctgggagccggcagcaaagaaacaggaggcaagtaatgattattgatgttcacgggcatctcggagaagatgtcgtatttgacgagcagcagacagaagaacagctgatggacgcgtataagaagaacggcgtagatggagcaatcatacagccatatctgcccagaatctatatggaagaccatgtacggatccatgacagaatctatgagatgacaaaatgcaaagagaaaaggttctgggggatggcgtctatcaacccccacttcaggccagaagagtatgataaagaggctgtccgatgcattcgggaactaaaattcgtaggcatcaagattacgccgatcggtcatgcctgccatccttcctcgaaagacgccatgcacgtctgggaggtgtgcagggaactgaaagttccgcttatgatccatacaggcgcaggaattccattttctgatcctatgagcgtggaaaaggcgttgagaagttttcctgatgttccatgcatccttgcccatgcaggttcggagatgcaccatcagcaggcagcgtatcttgccgcgaagtatgagaatgtgtatctggagccaagctgggtgggagtgattggcgttatgaatatgatcaggcaggtaggctgtgacaagattatgttctcgtctgataatatataccagattccagtggaactggcaaaataccgctctgtcataaaagaggaagaagaacttgaaaaggtactgtataaaaatgctgccagggtctatgggctagacgtggactaaaggcaggaaccaaaaatccggctatcatccgctcgggggcgtgatagccggattcttttaatcttggagcaagtcataccagatatcaatcgtttgtttgatgcattcctcgatatcatcataggcttttgattcgatgatgtgatagatctgagagtgtgccttgtatacatactccccattctggtgcttatgggtatgagagatggatgcacggaaagaatccatgacaaaatagtatattctggacgccagcgcgttgcagctggcttcgccgagaatatggtggaagtccatatcatttttcaaaatcttgtcaggggcagcgccctcctggatcagtgcgtccagttccttgagattttcccgcagagaattacgctgttcctggttttcgtcatagtggtcgatcgcaaggcgtacgatatcggtttcaaatatacgccggaattcatagaggcttgtgagatcggggttggtgatgaagtatgtaaacagcagggaatccagcagctcgctgctgggcgaatcgctgacataggttccgtttccgacgcgtatatcaatcagcccaaaagccgagaggatcttcattgcctcgcgcacagagccgcggcttacgccaagcccttcggatatctccaattcattaggaagtttgtcacccgggagcagcttcttatctgccaaaagctgcttgatgctgtttacgacaatatctacagcagactctctcttcgtggctttaaatagattatccatatatgtaacttcctttccgtaattttaggctagagatagaaaaataaggatgtattgtaaaaaaataacagtttctgtatttcattataacggtgcattaatataacgtcaaacgattaattgctaatttgtctaaaaatgttgacaaaacaacactcatatgatatatattaaacatcagatgtttgatgttgattcaatcaatgttaaacaaatggagtatataattacatttgataatcttgaatacgaggaggaattctttatgaatagggaagaactgaaggcgactgcagaccgtctccgtctggtggcggtggatatggtctacagaggaaaggacggacatccgggaccagcactgtctatcgcggatattgtcgcgacattattctttgataagatgcgcatagatccaaagaatcccggatgggaagacagagaccgcttcatcctgtcaaaaggacatgcatgtccgatctattatgcagccctgtcagagagaggatatttcggagagaaggtagatgacttcaggctcagggcgctgggcagcaagttccagggccatccggtaatgaacaagacgccgggagtcgatatgacatccggatcactgggaaatggaatcgctatcggagcagggatggcaattgccggtaaatacagaaaaaaggattacgatgtatttgtgattgccggagatggagaactccaggagggaatctgctgggaaggaattaaccttgcggcagcaaagaagctggatcatatgattgtattcgtggacaaaaacggatggcagagcgggggttctgtggaagagacgataggctccaacaatatagcagaaaggttcgctgcattccagtggcacacccaggagattgacggccatgatattgatgcgatcagaaaagccattgacaatgcaagggcagaaaaaggacggccaagcgttatcgtatgcaactgcataaaaggaaagggactcccatttatggagaacaacaatgcatggcacaaaggtgttccttcagatgagcagtataaagaggcagtaagaatcttaggaggtgttcagtaatggcagagtttaaagggacgagagaagcattcgcgcaggcattgatagatctggctgccgagaatgacaagatcatgttcgtatcaccggactcattgaaagcaatgcgtgccacggagtttgcaaaactgcatccggaacagtacgtggagacgggaatctctgagcagggagcggtagacgcggccgcagggcttgcatcagcaggactggtcccattcgtcggaacctatgcgggatttctgaccatgagggcttgcgagcagatgaggacctttgtcgcatatccaaatctgaatgtaaagtttgttggaatcaactccggcctgctgggaggagaaagagagggcgtgacccatcagttctacgaggatcttggcattctgtccaatatccccaattatacgatcctgacgccggcggacgcggcacagacctaccatgcggtaaaaatggcggctaagattgacgggccggtctatgtacgggcaggaagcggacgggagccggatgtctatgataaagagacgccttttggcgaggaaggaatccggatattgaaagaatatgggaatgacgcgcttcttctatccagcggattcgtgcttgaccgcgtgctcctggcggcggaactgctgaaaagccagggaatcaacgtgacggtaggagatgtaaatatattatatggaaagaacccttccaagatattagaagccatagcaggagccaggaagatcgtaacagtggaagaccacaatgtaaatggcgggctgggggcctatatcagccggctgacagcggaaaacgatcccaagatcgttaagagaatcggcctttctacttttggagagtcagggccagccaaggaattggcagacgcttatgggtttgcgcccgaagatatcgcaaagacggtggcgcagctgtaataacttggaactagggaaaagaggtagaaaagatgagcaaaatcgtagtaagtgtaattggagcaggcggaaagatgggggcaagaactagtaataaccttgccaagaagccagatgagtttgaactgcttatggcagaggcgtctgaagccggaataaaaagtatcaaagaccggggatttgagccggtaccggtagaggtggcgctggcgaagtcggatgtagtggtatttgcggttccggatacattgatcgggaaactgtcggcggagtatgttcctcagctgaaggcaggaaccggcttcattattctggatcctgcggcagcagttgccagggaactgacattacgggatgactgtacgttcgccgtggcgcatccttgtcatccatcttattttatcgaccaggatacctatgaggcgcgccaggacaggttcggcggctgcggcggcaggcaggacatcgtaatgtccaagatccagggagatgacgagcgctttgcgcagtgcgtggaagtggcgaagcagatgtatgccccggtagagcatgcatatgtaatgtcatccgagcagatcgcgttcctggaaccaacgctggttgaacttctgggggcgacgtgcctgtatgccatggcagagacggtagaggaggctgtgaaaaggggaatcccaaaagaagcggcagtctctttcctgacaggacatatctataacctgtccgccaatttccttggctacataccgggaaatcctccggtgtctgatgcgtgcaaggttgccatcggtctgggaaacaggctggtaatgcgtgaggactggaagcagatttggaaggatgatgtgcttgacaaggtgatcgcaaccatgcttcatcctgagaatccacagatataagggggaaaacaatatgaagatcgtagtgttagatggctatacgctgaatccgggagacttggactggaaagggcttgaggaattcggggaatgcaagatatatgacaggactccgatccaggacacccaggaaataatcagaagaatcggggacgcgcaggcagtgtttacaaataagacgcctctgcccagagaagtgtttgaaacttgcgggaatatagaatttgtcggcgttctggcaacgggatataatgtggtggacatcgaggcggcaaaggaaagaaatatcccggtttccaatattcctacctatggaactgctgcagtgggacaattcgcgatcgcgcttctgctggagatatgccatcatatcggctatcacagcgaggcagtgcgggaaggaaaatgggcccggaatccggactggtgcttctgggactatcctctgatcgaactggatcaaaagacaatgggaattatcggttatggcagaatcgggcagtctacgggaaggatcgcgcaggcgttgggaatgcgcgtgctggcatatgattcctaccagaacccggaactggtatccgatacctgccgatatgccgctttggatgaactgctggaatgttccgacgttatcgcgctgcattgcccgctgttcccagagactgagaagattatcaataaagatacgattgccaagatgaaggatggcgtgatcatcctgaacaactccagaggaccgctgattgaagagcaggatctggcggacgcgctgaagagcggaaaagtagcggcagccggactggatgtggtgtcctctgagccgatcaaagaggataatccattgcttcaggcgccaaactgcctgataacgccgcatatctcatgggctccgaaagaatcaaggcagaggctgatggatatagcagtcggaaacctgcgggcattccttgcaggaacgccagagcatgtagtaaataaatagcgtagttttattcacaatgccatgatgaatttaaactaaaggcgaatcccttccggcacagtctgtcgggagggattcgcgtgtaagaaaaaggaacttccccaaaacaaggttttttggtatagtataaagatacaggacagtcaacgatgtttacagatagaaagtgggaagggatatgagttttgcacatcttcacgtccatacagagtatagtctgctggacggttccaacaaaataaaagaatgtgtttccagagtcaaggaactgggaatggacagcgtagcgatcacggatcatggcgtcatgttcggcgttattgatttttacagggctgccaaggccgtcggcatcaagccgatcctgggctgcgaggtctatgtggcgccaggctccaggtttgataaagaagcagtgggaagcggggacgacaggtattaccatctggttcttcttgcggagaatgatctgggctatcacaatctgatgaagatcgtatcccggggatttaccgagggatattattataagcctcgtgtggatatggagatcctgaaggagttccacgaaggcatcattgccctcagcgcctgcctcgcgggagaggtgcagaagaatattgtccgcgggatgtatgaagagggaaaggcagcagcattaagataccaggagatattcggggaaggaaatttcttcctggaattgcaggaccacgggatccaggaacaaaaattggtgaaccagtcgctgcttaggatggcaaaggagacgcagattggactggtggccaccaatgacgtccactatacttacgcggaggatgagaaggcccatgatatcctcctgtgcatccagaccggcaagaaggtggcggatgaagaccgcatgcgttatgagggcggccagtactacatcaagtcggaagaagagatgaaaacactcttcccttatgccctggaggctcttgagaatacgcagaagattgcggaccgctgcaatgtagagatcgaattcggcgtgaccaagctgccgaaatacgatgtcccggaaggctatacttcctgggaatatctgaataaattatgctacgacggattaaaggagcgttatccggacggggaagaatccttaaaggagcggctggagtacgaattatccgtaatcaagtccatgggatatgtggattatttcctgatcgtgtgggactttatcaaatatgccagggaccatgatatcatggtgggtccgggaagagggtcggcggcgggcagcatcgtgtcgtatacccttggaattaccagtatcgaccctatcaagtaccagctgctgtttgagcgtttcctgaacccggaacgcgtatccatgcccgatattgacgtggacttctgcttcgagcgcaggcaggaggtcatcgactatgtagtggagaaatatggatccgaccgggtggtgcagatcgtcacctttggtacgatggctgccagaggcgttataagggacgtaggaagggttatggacctgccttacgcattcgtggacggtattgcgaaaatggtgcctacagagttgaatattacgcttgagcgggcattgacggttaacccggaattcaaaagaatgtaccaggaggacgagcaggtcagggaattgattgatatgtccaagaggctggaaggacttcccaggcatacatccatgcatgcggccggagtggtcatcagccagaaggcgatcgatgagtatgtgcccctgtctttgggatctgacggctctgtcaccacccagtttaccatgactacgctggaagaactggggctgcttaagatggacttcctagggctacggacactgaccgtgatccaggacgcggtcaagctggcaagccgctcctctggcaaagacattaatatggaacagatcgactataatgataaggcagtgctggactccataggaacggggcgtacggatggcatattccagctggaaagcggcgggatgaagagtttcatgaaggagctaaagccgcagaacctggaggatatcattgccggcatctccttataccgtccgggcccgatggatttcataccacagtatatcaagggaaagaaccatacggataacatcacttatgactgccctcagctggagccgatccttgcccctacctatggctgcatcgtctaccaggagcaggtcatgcagattgtacgggatctggcaggatacacgctgggacgaagcgacctgctgcggcgtgccatgtccaagaaaaaaggcgatgtcatgaagaaggagcgccagagcttcgtgtacggcaatgaggccgagggggttcccggctgcatcgccaatggaattgatgaaaagacggccaataagatctatgatgagatgattgatttcgccaaatatgcttttaataaatcccatgcggccgcctatgcggtggtatcctatcagacggcatggctgaagtattactatccggtggagttcatggcggcccttatgacatccgtcattgaaaatccggggaaagtatcagaatatatctatacctgccgccagatgggaattgagatcctgcccccggacattaacaagggagaggggagcttctccgtagataacggcaatatccgctatggactggcggccatcaagagtatcggcaagccggtcatccaggcgatattgacagaacgggaggccagaggggaattcaagaatatgaaggatttcatcgaacgtctctctggcaaagaagtcaacaagcgtacgatcgaaagttttatcaagtcaggcgcatttgacagcctgggcgggaccaggaagcagtttatggtcatctacgtgcagattctggatcaggtcaaccaggaaagaaaatattccatgaccggacagatgtctctgttcgatatggtggatgaggatcagaaggcagagtttgacattccgcttccggatgtgggagagtacgagaaggaaacgaagctggcatttgaaaaagaagtgctgggcgtgtatcttagcggccatcccatggaagaatatgaagagaagtggcgaaagagcatatccaagaccaccctggatttccaactggtagaagataccgggcacaccaaggttttagacggcgccagggaaattattggaggaatgatcaccgacaagaccatcaaatatacgaagaataataaagtaatggcattcgtgaccttggaagatatgctgggatcggtcgaagtggtggtgtttccaaaggattatgagaagaatcagcagtacctgaatgaggacagcaaagtattcataaaggggcgggtatccgaggaagacgatgctcccagcaagctgatctgcgagtcggtgattccctttgagcagacgaagcgggaattatggcttcagtatggcagtaaagaagaatacctggcggaagaggcacggcttctggaactgatcaaggactctgacggacaggatgcggtggtcatctactgccggaaagagaaggcggtaaaacggctcggggccggccggagcgtaagcgcggatgcccgtctgttaagcagattgacgaattatctgggggaatcttgtgtaaaagttatagaaaaacccattgaaaacattcgttaattcatgtacaatgtagcacgaggatagtaaggaattaagaagaacgctaatacaatggaggaattaagatggcagagaaaataattcgtacgataggcgtattgacaagcggcggggacgcgccgggaatgaatgcggcaattcgtgcggtagtcaggacggcattaggaaaaggactgaaagtaaggggcatcaggagaggataccagggccttttaaatgaagagattattgacctgtcagccagagatgtatccgacaccatccagcgcggcggcacgattcttcagacagcgcgctgcgacgagatgcgcacagaagaaggacagcagaaggcggcggctatctgtaagaaatatggaattgacgggcttgtagtgatcggaggagacggttcctttaagggcgcccagaaactggcgaacttaggaatcaacacaatcggcttgccggggaccatcgatcttgatatcgcctgtacagaatatacgattggatttgacacggcagtgaatacggcaatggaagcgatcgacaaggtacgcgacacttctacttcccatgaaagatgctctatcatcgaggtaatgggtagagatgccggatatctggcactgtggtgcggaattgcgaacggcgcggagcgtatcctgatgccggaagagcatgattataacgaagaggcgatcgttgccgatatccaggaatgccggaagcgtggaaagaagaactatatcatcatcaatgcagaaggcattggcgattccatgaacatggcgaagagaatcgaagaggcgacaggcatggagacaagggcaacagtgcttggacacatgcagcgcggcggaagtccgacctgcaaggacagagtctatgcatccatcatgggagcgctggctgtggatctgcttgaacagggcaagacgaaccgcgtggttggatacaagcacggagaatacgttgattttgacatcgacgaggcgctgggcatgcagaagggaattccggcataccagtatgagatcgcaaaggaacttgcattataggaactctatgaggaaaaaaggcattggatgaatcagaatccaatgcctttttataatacacaatagttatgattttatttggaaagagaggatacgaaaggatatcagaaaggccatacgcaagcaggcgggagataccgtgaacgtcacgatacaagaacgcccataaatcccgctttgatccgctttggggaaattactcttgaaaacagcagggattgacgttacaatgagtattacgaatggttttaaaggagataataattgtggagaataatagagaaaatacagcgccggtaggagtgtttgactccggtgtgggagggctgacggtagcgcgggaaatcatgcgccagcttcctatggagaatgtggtgtattttggagatacggcaagagttccctatggaagcaagtccagagataatattatccggttctccaggcagattattcgctttttggagacgaagaatgtaaaggcgatcgtgattgcctgtaatacggcaagcgcccttgcgctcgacacggtgcagaaggagacggatgtaccggtgatcggagtgatagggccgggagccagagcagctgtcaaggagacaaggaacggccagatcggcgtggtggggacggaggcgactatacagagcgagacttataccaaagtgatacatagcctgaatccggaggcatccgttatcggaaagccatgcccgctcttcgtgccgctcgtggaagaggggtttgcaaagcacaagattacggaagaggccattgatttctatctgtcggatatgaagtcaacgcagattgacacgatgattctgggatgtacccactatccactgcttcgctccaagatcatggcttacttcggagaagagatccatatcgtgaatcccgcctatgagacggctatggacctgaaggctgcgctgaatgactgcggcattgccaatcagtcaggcatacccgcgacctatgagttctatgtaagcgacgccgcccagaagtttacgaagttcgccaattccatcctgccatatgatgtagcggcaacgaagcagattaatattgaagaatactaggagagcctatgacaaaggatgtattacttagcatatccggcctgcattacgacgtggccggagtaacggaagaagacgagaatgaaccgatcgaagttattacgcctgcggcatattacttcaagaacggcaagcattatgtgatctatgacgaagtggtggaagggatgcccggcacgatcaagaataagatccgcattgccgaggacggcaagctggaaattatgaaaagcgggcttgccaacacccatatgatctttgaaaaaggcaagatcaatatgacggagtatgagacgccgtatggagaacttctggtggggatccatacaaaagaaatgacggtaaagtcggaggaaaaaatcatagatgtccatgtgaattatgaattggacgtcaatggagagatggtggcagactgcaacatcgagatgaatataaaagcattggaccggtaagatccaatgctttttatgtggcttgtccttatttgttccttaatcttgcgaagaagcctttcttcttctgaggagtctctaatggccctcttaatcctttaaccgcggtaatataaataccgcttacggtagcctttacttccttcttgacaggaattaacgggaatacctgggcatcgcacatcaatgtcattacctttggccctaccttggcctttactacaggaactttagagcggcgcagatacttcggcgtcccttctacgacaatgcttgggaacccggcttctttaagcctcatcttgcctttatcaatgataagcatggacacggtctgtgcgacggcagccagctgctcctgctgttcggcctgctttttttctgctctttttcctaagaaatacaatacgatgcaagcaatgattaaaacgactaaaataacaagcaatacaatcgttaacgtcttcacggcgaacctcctaaaaatctattttacacgaactacattgtaccattctttgaacgcaagtgcaagagatttgagattttggggttacttttccggcaagaaacggtataatagataaaataacgagatttttaaggagagtagcatgcttcatactgtgacggagggaattggaaccgtatattggtggatacttgaccatctgtttcttatcaacatcatatttgcgctgctgatcatattttttcagcggaggaatccgacgacggtgtgggcgtggcttttgctgctttactttataccggtgctgggatttgtgctgtatctggtgctgggtcagaatttccgcaaggatcggatgtttaagatgaaggagattgaaggagagatcaaatatgctgtccggcggcaggaggaatcgatctatcgtaggaaattaaggcttcgggatccagaacttgagcggttcaaaagcctgatcttatataacctgaacgaaggagaagcagtactgacggataataacgatatcagaatctatacggatggacgggagaagtttaatgcgctgctcacagagatggagcatgcgagaaactacatccatgtgcaatattatattatccggaatgatgaactgtggcaggagatagaagaagtcctggtcaggaaggcgagacagggagttgaagtccgggtgctgtttgacagtatgggttgcagagggatgcgcaactcagactgggtgcgccttgagaaggcaggtattgaggtggcggaattctttccggcgatcttcggccagctccagttacgcgtgaattaccggaaccacaggaagatcgtggttatagacggaagaatcggattcgtgggcggattcaacattggaagagagtatgtggggaaggataagaagttcgggtattggcgggatacgcacatctgcatcgaaggctcggcagtcacttccctggcagtaagattcgtgctggactggaattacgcagctaaggaaaatctgtttctggaggatcggctttttgagattccgacgtatatccggaacggacgcgatccgattcagatcatatcaagcggcccggattccagaagccaggagattcgtgacaattatctgagactgattcatatggcgaggaaaagcatctatattcagaccccgtatttcataccggatgatgatattgcggatgccctggtgattgccgccaagtctggaatcgacgtgcgtatcatgattccctgcaagccggatcacccgttcgtatactgggcaacctactcttatctgggcgagatgatcgaggcaggagcaaggtgctacacttatgacaatggattcctccatgccaagtgcatgtgcgtggatggactggtcagctgcatgggaactgccaatatggacatccgcagcttcagcctgaattttgaagtcaatgcggtgatctacagcgccaggacgacggagaggctgatggaggcatttgagaacgatattaccaagagcactctggtaacaaggaagaagtacgagcagcgcagtctcctaatccgaatcaaggaacagttctgcaggctgctctcgcctgtgctgtaatcggcagggcagattcttaataaagagtgaaatatgtgtgaaaatgctttgaaagttctgttaaatgtgctataacataatagtgcgatttaacggaaagtataataagaggtgtaaaatgaagaagaaaattgtagtgctattaacaggaatacttgccgcatccatgatgctggcaggctgcgaagggagcaagggtctggaaacagacagcctgaaaatatcccaatataaaggagtagaagttgatcaagtcagcaagccggatgagattacggataaagacgtggaagatgcgatccaggcaacgcttcagaccaatgcgaccactaatgatatcactgaccgggcggtgaagtcgggggacacggtgaatattgacttcgtaggaaagattgacggagtagaatttgaaggcggatcaggaacagactacccgctgaccataggttccggccagtttattgagggatttgaggacagcgttgtggaccataatatcggcgatacctatgactgggagggcaagttcccggataattacaataaaacggaatatgcaggaaagccggtagtatttaccattacggtgaagtccatcagcgagcaggtggttccggaactgaacgatgaattcgtaaaaacggtctccgagaaatcaaagaatgtaaaagagtacaagaaggaagtaaaaaagcagctggaagacgatgcccagactacttacaaggatacgctgacccaggaagtatggcagaaagtcctggataatacaaaggtgaaaaaatatccgaagaagaaggtaaaagagatctctgattccctggtcgagcagtataaaacggcagcggagtattatcagacagactacgagacattccttaaggagcagatgggaagttctgtggaagatttcgaggcccaggtggacgaagcagccaaatcaagcgttaagcagcagttggtgacggatgccatcgcggacaaagaaaagatcaaaatggatgataaagagtacgagaagcagttgaagaagattgcggacgcgtacggatatgaagatgtcaaagcagttaaggaagcagcatccgaggaagacttaaaggagattgcactgaataacatggtgaaagaatggctgacagagcactgcgtgcaggttgcttccaagtaagccaaagaaaataaaagaactgataagaaggcaggcgacagagcgctctcttatcagttctttttttgttccaacttaggattccgctgctttaggaagcagcgttgagccgcgcacgattaattctgtgttcaaaagaatctgcttggatgatgaggctggattgatgattttatcaatcagcagttcgcaggactgatacccgatctgaaagcagggctgttcgatcgtggtcagcggcgggatgcacatgacagacagatcaatattatcgaatccaacgacagatagatcttccggcaccagaagccccagttcgtgggcagcgttaatggccgcaaccccatatacgtctgaagtggcaaaaatggcgtctggcctgtcggcctggcttagcatatgataaatgttggaaaaagccagtttataatctgtggttgacagatgaatgatccattcgggcctgacaggaagcccggcttgctctaatgcctgacggtatcccttttcccggtggcgggcatatttaaaggataaattcgtgttaataagactgattttttcgcgtcccgtcgagatcaggtaatctaccgctttcttggaagcggcggaatcatctatgctgacataagatacccggtcataattctcggcatattccgaacacatgacggttggacagcgaaaacttagatcctccagaatcttttgctgaggcatattggacatgatgaccattccagcgattgaattattccttatcagttcttcaaaatcttcgcttcttgaatagcggtcccgggtctccaggatcagcacatgatatccgttcgcgtgggcgcagcggtgtatcccttccaatacgggagagttaaaaggattatccagattgggcacgcataccatgatgatcttgctctgcgcttctgagagcatcgataatgtcttcgggataaagtttaattctttcatagccagttctactttttctaaagtgctaggcttgatatttcctttattgttaatgattcttgatactgttgcgatggatacgtcagccatatctgcaacatcctgtatcgttggtttttgcttccccataaaacctccaaatatttccaattattttaacctacttataatattatatgtttttcatgaaaatgtaaatagaaatgtaaaatttacaaaataaaacagcataacaaataaatcgagtcaatatttatgtgcaatatacacaagaaaaataaaattataaggaaaatattgacaaaaatagcattatggtgatataaataatgtaaagtttacgtaaataataataaaatttacaaaaaaggagaaaaatatgaaggctgcggtaattggaggaggttttattgggaacgcgcatgtcgaggcattgagaaggctgggagatgtggaggtagtcgcattatgtgacgcgtataattccagggagaaggctgacagactgaatatcaggtttgcctattcagattttcgcaagatgatggaggaactggaattggatgtagtgcatatctgcacacccaaccatacccactacgagatcgccagacacgcaatccaaaaagggattcatgtcgtatgtgaaaagccatttacaagcacagccgaagaggctgaggaactggtaaggctggcgaaagaaaaaggcgtgcatggaaccgttaattttcacaaccggttttatccggcggcaatccagatgaggcatatggtgtccgaaggggagatagggagagttataagcgttcatggcgcgtatatccaggattggcttctgtatgagacggactactcctggagggtagaagagaggctgggcggaaagataagagcggttgcggatatcggctctcattggctggatctggcgcagttcgtaaccggacaggatataaagaaggtctgcgctgtattcaataccatttatcccgtcagaaaaaaaggaactgccattggggagtcgtttgcaaagacaggccagggagaacttgaagaagtagaggttacgacggaagatgaggctgcaatcctggtcgagctggaaaatggcgcaatcggcagcgtgttcataagccaggtatttgcagggaagaagaataccacggaattgctggtggccggtacatgtgcatcccttggctggaactcggaagaattgggagaacttggaattggacaccgggacggcccgaatgaagtgcttacgaaagatccttctttgatgtgcgaaaaggcagcggcggcgattggcttcccaggcggacatgtggaaggattcccggacgcgatcaagcaggggtttaggcagttctacgacagcctgagcaaagaaggagatttccagtacgccacgttccaggacggcctggaggagattaggctttgcgatgcaatcttgaaaagcgcgcagacaaagcagtgggtagaagtagaaccgccggatcatgcataggagggaagaacggatgaaattggggcttttgacatcgataatgccaacgagcagtttggaggaagtgatagaattcgcggcacagcagggattttcctgcatagaggccgcatgctggccaaagggaagggcaaagagaagatatgcaggagtcacccacattgatgtggaacacctggatgacgggcaggccgcacggattaaagatctgtgcagagccagaaatgtagagatatcctccctggcctattatcccaatgtgctggatgaagacgagaatagcagaaaggcagcggaaagtcatcttaagaaggtgatagatgcctccaggaaactggaaatcggaatggtgacgacgtttatagggaggaatcacaataagaccatcgaagaaaacctggagatcatgaaaaaaatatggacgccgctgcttagatatgcggaagagagggagataaggatcgctatagaaaattgtcctatgctttttggcaaggaacagtggcctggaggacagaatttattcggcgcccctgccatttggcgggaggtatttgagatactgccaagcagctgcctggggattaattatgatccttcccattttatctggcagatgatggattatatccagccgatctatgaatttaaggataagatttttcatgtacatatcaaggatattaagattcatagggacaggctggatgacgtgggaaccatggcttaccccttgagttacatgcagcccaagataccggggcttggagatattgactggggaagatttattagcgcccttatggatacaggctatgacggcgcagcctgtatcgagatcgaggaccgggcatttgaaggaagcgccgaagacattagaagatcaattattctgtcaaagcggtatatggagcagttcatcatttagatgcaaatctatcaaaatacaaaggaggaagaaagtatgatgaaaaaaatgttgagtgtaggcttgattctggcaatggtgctgtcgcttgcggcgtgtacgggaaagagcaaggaggcgggaaaagacgacgaaaagaaatccaaatcttcggatggcagttatgagatcgccatcgtccctaaagatactaccaatgactggttccagtgcattgcacagggcggtgaaaagtttgggaaggaaaaaggatgcaccgtctatatgaagggcgggacgtcggcagatgcatcattacagatcgaggttatcgaagacctgatcgcgtccggcgttgacgcgctctgcgtaatcccgaatgatatcgacgcgcttgaaagcgtgctgaagaaagcgcaggatgccggaatcgtggtggttacccatgaagcatccacgcagaagaatacggaatatgacctggaggcctttgacaatgcgcagtttggagcaacgatcatggattctctggcatcccagatggaagagaagggtcagtattgcgtaatggtaggaagccttaccaatggctcccacaacgaatgggcagatggcggcatcgcaaggcaggaggaagaatatccggatatggaactggtaggggacaggattgagatcaaggacaactcggagactgcttatgagaaggccaaggaaatgctgaagacctaccctgaactgaagggattcttcgggacggcagcccagtgcgtgccaggagtggcaagggcaattgaggaactgggcctggtaggaaaggtatccttatgcggaatggcattgccaagcgctgccggagaatatattgagcggggaacaatggagactattgttgcgtgggatccttacgaagtgggatatgccatgtccaacctggcctacatgattctctccggcgaagagatcaaagagggcatcaatctgggggcagcaggatatgaggacatgaatatcatgaatgataaagtgctggttggttccggcttccttgagatcacaaaggacaatttgaaagactatgacttctagagaactatcccaaaggcaggggatatatggggacaggcgcccctgcctgagggagcgggagaaagaaaggatatggctatgtctaattatgtattgagggcaaaggaagtctgcaagactttttccggcgtgtatgcgctgaataaagtgaacattgacatccgccagggagaagtgcattgtctggccggggaaaatggatgtggcaagtcgacgctgattaatattatctctggcgtatataccagagactcgggagaaatagagctgaacgggaaggtatataagaagatcacgccggcggaggcaattgaagaaggagtccaggtgatctatcaggactttgcggtgtttcccaatctgacggtgaaagagaatctttccataagcacgatggtttcatcccataagaagattatgaactggaaggagtctgagaaaattgcgcagaaggctatggagatgattggcgtagaactggatatggagcaagaggtaggagaaatatccgtggcagacaagcagctggtggctatttgcagggcgcttatcaacgatgcgaaacttctgattatggacgagccgaccacggcgcttacaaaacgggaagtaaagacgctgtttcagacggtccttaggctgaagcggcagggactgtccattctctttgtaagccataagctggatgaggtatttgagatatgcgacagatataccattctcaggaacggagagaatgttctgactggcagcacggaaaaactggataatcgaagttttgcctattatatgaccgggaggcgttttctggatgtgaagtttacagcctcaaaaaaggggaaagagcctttgcttgaagtgaagcatctgacggcggagggtgccttttcggatgtgtcgtttacgttatatcctggcgagatcttaagcgtggtgggcctgctgggatctggcaggacagaacttgccctggcgctctttggaattcagccggcatcctccggagagattatgattaagggcaggaaagcgtgcatcagcaaagttacggatgcggtagggctgggaattggatacgtacccgaggaccggctgacggaggggctgtttatgaaacagtccatcggggataacctggtcatttccaagattgaaaaacttgcaggccggcttggaattctaaaccgaaagaagatggaagccgaaaagacggatatcatgaagcgcatgaagataaaaagcccgtcgccggattatgcggtatctaccctctcaggcggcaatcagcagagagtcgtgctgggcaaatggattgcgcggaatatggacgtgctgattctaaacgggccgacggtaggcgtggatatcggatccaaatacgacattcatcaggtgatgaaggaactggcggatgaaggaatgggaatcctgatgatttccgacgaccttccggaagtcctggcggtatccaatcgaggcatagtgataaaaaacggcagaattgccggcagttttgaaacggatggcacgacgacagaaatgcttgacgagatgattggtgtctaaggagggtgaaaagtgacgttaataaaaaaactactgcatagaagcgaattctatctgacattcattattttggtctttgcattctttgtacaggcccggagcgggcaattcctgacagccaataatctggtggatctgtgcgtatccatgatcgtgccatccatcttctgcatgggaatgcttctggtagtcattacagggggaatagacgtatcttttacggcgttggcgagcctgtctgtctatgtgggcattgatatccttcttcggatggagtatgaaggcagcgtccttgtggcctttcttctagtggctgtactgtctgccgccctggcggcgcttaatgggctgtttattgccattctggaattgccgccgctgatcgtgacgctggggaccatgtcagtattccagggaattctcctcggaatcctgaacgcatcatcccagaacgtcctgcctgagggaatgagcaagttcgggctggcaagcctgttccaggtaacgaacaagaagttgaatatcacttcggccatgccctattccatttttcttctggtaggaatcgttgtggcaacctggctgatcctgagacacacgatgctgggaagagggatatacgctgtgggcggtaataaaaatgcggcagtcaggatggggttaaaggtaaagaagatcaaattctttgtctattgctatattggagtactggcaggaatcgcggcagttattcgcatctgcatggcaagatataatccgcccggcaatatgatggggatggagatgaatgtcatcgccgctgttgttctgggaggggcgagcctaagcggtggaaaagggaccatactcggaacgctgctcgggatgggactgatgacgctaatggagaacagcctgctgcttctaggagttccgggctattggcagactttatttacaggaatcattattgtcatcgggacttcaattacctcttaccgggcggcgaatataaggaaaagatcagtagacagaagagggagtggaacatgcaaaaaagtaaacgaaatttaaataattggttattgctatatcagaaagataaaatattttttcaattgctgatcattgctgttcttgtctttggggctgtagcgtttatgaagccggacaagttcctgacttctgaaaatatcctttctatgctaacccagtttcctcaattcgggattatgacatttggagtaatgctggctatgcttctgggaggaatcgatctgtcaatcgtggctattgcaaacctctcatctattgtcgccgcttttattatgaccggcggcacgggggcgcaggaaggcagggagatggcgatactggcaggtatcattgcagcggttatcgtgggggcggctgccggtctaattaatggagttgtgatatcgaactttcatgtgccggcgatgcttgcaacaatcggaaccgcccaggtattccagggagtatcgatcgcgcttacgaaagggaaggcgatcagtggtctgccagaggcgtactcgtcgatcggcggccttaatgtagcgggaatccttcccgttccattcctggtgtttataatctgtgcggtgatccttggatttatcctggcacgcaccacgtttggagccaatatctatatgcttggaaccaacgtaaaggctgctggatacagcggaatcaaggtgagatcatatacgcttaagctttttgttatagggggaatcctggcagcgttgggagggatggttatgatgtccagaaccaacagcgcgaaagcggattatggggaggcctacacgctgcagtgcgtcatgatcgcaatcctgggaggcgtggatgcacaaggaggcgccgggaaggtccgaagcgtggtagttgccatattcatcgtacagattatatcgtcagcgatcaatatgttcccggtactgaatacatataccaagacactgatatggggacttaccctgattgccgtcatggtatggagaatgttctcgaaagattaaaggaaaggagagcattgtgcaagacaaaggcacagtgcggttagtagatatggaaaatgcaagccagaaatttaccaaattattatcaccattcaagatcgggaagatggagctgaagaatcggtttatctttctcccgcatcttaccgggtatgcaattgatgaggggtggatggattgcggcctgttctccgagcgcaacatccagcattatgtggagcgggcgaaaggaggagcggcagcagttacagtgagtcagaatgttgacccatacagcatgatgtccgacgagtacccggttggaagcgatcccaggaataaagagaacttcaggaggctggccgcagaggtgcataagtatggctgcaaatgcatcacgcagctgaatcacggaggacataatacgctgaagaatcctccgcagattcttttggcaccttcccagatgccagagccatcctgccactttaatacaaaggaacttgaaaaagaagaactggagcagatcaaagattattatgtcaaggcagcaaccctgcagcagggcgtgggctgggacgcagttgaacttaagattgcccacgacgggcttcttaggacctttatctcaccgttgttcaataagagggaagatgagtatggaggcagtttcgagaacaggatgcgctatccgctggagatcattgaggccatccgcgaagcggtgggcccggattatcccatcggcatccgcctgtgcgtggatgaattcatagaaggcgggtattccatggaatacgggctgaaagtcgccaaacggctggaagaagcaggcgtggattatctcagtacggatgcaggatcattcagttccttctacatggagattcctccggctgtcattcccttagggttcgcactctatatgagcgcggaattaaagaagacggtggacatccccgtcattgcctttgggcgaattaatgaccctgtccaggcagagatgctgcttgaagagaactgcgcagatctggttggcatgtgccgccagctgatctgcgatccagagacgccgaataagacgatgcggggagaagtagacgatatccgtcactgtatcgcatgcaatgaaggatgcattggaaatgacggcattgatgtggaatgcgtacaaaatccgggggcaggccgggaaaagtattttggcattgggacgcttcagaatgcagagatacgtaaaaaagtcatggtcatcggcggcggaatcagtggtatgaaggcggcggagattgctgccaagcggggacatgaggtgtctctctatgaggcgggcgacaaattaggcggacaagtccttttgattgagaagatgccctaccgggcagaagtaggggaggtttatcgatatttaaaataccagttaaaaaaatataatgtagcaattcatatgaatgtgagagtagagcgggatcttgtggaacgggaaaatcccgatgtgattattgcggccactggctctaaggcgctgattcctgattatattcagatggatgaggcccgtataaaagtaatcgattgcaggcaggcgatggagaacctggaattgataggggacaaggtgctggtatttgatgacattggctattatcaagccagcggcgtggctgattacgtgacggccctgggggctgatacgacagttgttaccaccagcaacttccttggatgcgacatcgaaggaaccaataacgcattgctgctgcaaaggctgtatgagcggggcacccggattattgcctcccacacgatctcgaagattaaaggtgacgcagttgttctaaggaacgtatatagccaggaggaaaaggaaatcggcggatttgacacggttatcatagcggcccagagcagatcggataacgatctgtacaaagaactgaaagcagcaggtagagatgtgcgggcagtgggcgactgtgtcgcgccaagagccatcgaacaggtgatatttgatgccgagctggcaggcagagagatataaggaggatgtgggatgaacattgtagcatgtatcaaacaggttcctgacacgaatgaagtgaggatcgacagcaagacgaacaatctggtcagagaaggggttccttctattatgaatcctttcgatgaatcgggagtggaactggctcttcgcctgaaagaacgttatggaggaaggatcacggtagtttccatggggccgggacaggcgcgggaggcattgcagcaggcgctggatatgggggcggatgaagccatccttctgagcgacagagcatttgcgggttcggatactctggcaaccgggtatatcctggcacagtacataagcggcctcgattacgacctgatcctatgcggagcggaggcgattgacggctgtaccggacaggtgggcccggtgattgcggagaatcttggcattcctcaatttacatatgtaagtggagtagaatgggaagatgagcagtggaatatcgcaagaagcgtgggcagatatctggagtaccatgaagcaaagggaaagattctcgcatgcgtcatgaagcagattgcggctccgagagccgcgcacccatgcagccgaaatccgaaagttataagcgcaagggaaatcaagggactggatccaggacgtgcaggaagtacaggctcccctacccgcgtggtaaagattcagatgacagatgccaggcagaaatgctatgtggcaatagatgacaggctgccggcgagagaaagaattcagagtattattaacggaggcatagagtcaaaagaaaaggtagaattgataagagggtcttcagagtccttggcgtataagatactgagccttccggaagtggagagaaacgtagtctaagtatgcggggaaaggagtaatgacaatgatcaggatagaaaaagagagatgtaccggatgcggcatctgtatcagaaaatgtccttttggagcgttaaagatggaagaaggcgtgcctgtggtatcggacagctgcctggggtgcaatgcctgcgcgaatgaatgtccggcaggcgcgataagaaaagatgaggagagccttaaggcggaggacatcggtacctatcatgatgtattcgtgctggcggagctggagccgctaagcggaaaggtgcagaaagttacactggaattaattgctgagggacggcgtattgctgacaagttgggggaaaagcaaaaaactctgcttttgtgcagccagatgcccgaggatatagaggagagagcggggcgtgcgggatgcgatgagatcattctggtaaaagaccagatgcttaaagagtataatacggacctgtatgcggatattgttactagaatctgccaaaggtaccgcccgtcagttctgctgatacctgccacggagacgggaagggacctggcaccgcgggtttctgccaggcttcaaactgggcttaccgctgactgtacgggatttgatgtggatcaggaaggaaatctgatacagatcaggccaacctacggcggcaatatcatggcatcgatcatcagtccgggatgtcgtcctcagatggcttccgtaaggccgaatgtgtttgcggcagagacagaagcgaatcagaaaatggctgtgatcaaagaagaggatattgcgatagatccgggcaggaaaagaacccgccggacttcgttggaggaaaatccgaagtcctataagaacgtagcagaatccgatatggtgatcgtggcaggctatggcgtgggcagtgccgagaattttaagaagatagagcgtctggcagtcaagatgggggcggctatcggcgcgacccgcaaggttgtggatgaaggctgggccccgttcgatattcaggtggggcagaccggaaaaaccattgcgccggaattgtatattggatttggcgtatccggcgcgttgcagcataccatcgggcttcgaaatgcgaaatacgtggtggcggtaaacagcgacccggcggcccctatatttgccatgtgcgaccaggcgatcctgggcgactgcgtggatatagcggaacatatggaacgcctgcttgatggcaaggagggataaaaggatggatgttacctatagtacgaatgcatggggaatggttgcggcgcactgctgtggggcaaataatgtaaactatgcctattatatagcgacaggcgaagataagacggccataaaagagattgcagaagccgggtttgaaagcattgagatgtttgacggcaatctgctggcctatgaggagaagattgatagtctgaaagaattgctggagcaatgccggctggggttccgggcagtgtatagcgccgctaattttatctacgacgagattctggaggaagaatacggaaagatcatgcgcacggcccggattgcgcagaaactaggagccaggcaccttgttcttggaggcggggcaatccggcaggatggaatacaagagtcggattataggaagctagggaaggcactggatgagatctccaggagggcagaagacatcggactgaccacaagcttccatccgcatatgggctctctggtagaaagtcccgggcagcttgataaggtcatggaacacaccggcgtctggctctgtccggattgtggccatgtatttctgggaggagggaatccttatcagattacggaaaaatatctggagaggattaagtatttccatttgaaaggagttaatgaaaatggagtattctgcgcgctggatcatggcgagattgattttggccctatcctgaaactgctaaaaggatgtaaaagaaagatcgaactggccgtagaatgtgacgccaatagcagcgagccggggcaggatgccagggcaactgcccgatatcttgcagagcatggaatgaaatagataaaaatccttgtacaggagcactggcatctgtacagggatttttttaattaatatagccatatgaacgcaaatttggtagaatagaacaaaacgattggagaaagagacgatgtcgagagggaatgaaaaagggagagatgagtttcgcaccaggctgggatttatcgtagcctgcatcggatctgcggtaggcatgggaaacatctggatgtttccttatcgtaccggcaaattcggcggtgcggcattcttaatcccgtattttatatttgtaatcctgctgggattttccggcgtgatcggggagatggcgtttggcaggagtatgaagacagggcctttgggggccttttccaatgcgatggggatgcggtttggagaaaagggaaagaagtgggggaaggccatcgggatgataccggtgattggatcccttggcattgccatcgggtattctgtcgtggtgggatggtttttaaagtatctaagcagcgcggttaccggaagcctgacgaagatcgaagatatgggggcctattttggagggctggcggtagactttggaagcgtgggatggcagatgctgggcctggcgcttaccttcctggttatggccttaggagtaacgaaagggatcgagaagatgaacaaggttatgatgcccgtattcttcttgtttttcatcattcttctgattcgcgtggcaactttgccgggagcggcggaaggctaccgctatatgttcgtacccaaatgggagcagctgggggatatcaagacctgggtatatgccctgggacaggccttcttctccctgtcgctggcaggatccggcacgattgtatatggaagctatttaaagaaagatgtggacgtcgtcagctgtgcgaagaacgtggccttctttgacacttgtgccgcgcttctggcgggcgtggtggtgataccggcagtctttgcattcggactggacgttgccagcggtcctccgctgatgtttatttctcttccggcagtgttccagcagatgccatttggcgaggtgtttgccgtaatcttcttcgtagcggtgctttttgcggcgctgacttcgctgatgaacctgttcgagacgcctatcgaagcattgcagcagcaattcaaactgtcccggaaggcggcggtgggcattgtcgcggcggtatccgcgggagtgggagtcttcattgagagcggggactctgtaggcgcgtggatggatgcggtatcgatctacatcattccgcttggcgcgcttttggcgggaatcatcttctactgggtatgtccgaagggatttgcgagagagcaggtggagaccggggcgaaaaagcctctcggaatatggttcgagccggtgacgaagtatgtattcgtagggattaccctggtggtgtacgtgcttggaatcttctttggaggaatcggatagagcaagaaatataatatcctgcggcagattgcccttagggcatgccgcaggatatttttatgtcaggaatccgcctcttcgctggttatcatctgattcttcatgtccaggatcataaaggaaagatgaagctggaagatggtctgggaatcgccaaaatccaggccagtcatctccacgatccggttgacgcggtactttagcgtattgtagttcagatacattttcttggcagccacggacatttctgttccgttttcaatatagccccggatggtctccaggaaaagcttctgcttgtccgtatccagtttcaggatatccttgagggccggatggatcagataatccagagagccacggtccgcgtagtttaagaagatatgcggcagaagatagtcgcagtagcgaatgacgcgctccttgcgatgcagcttccaggctgtattgagcgcggccacggcctgcgagaactgttcgggaagagaatacaggttcttgctggaataactgatgccggcccggcagttctgcttttccagaaggacattgaactgctggaagtcggattctgtgaagacggaatccgtctttgtatcgaagatggctaccaggaatcctttatagtatacgatggtattccttgccagaaagttctggagcacccgctttaatacatagatcttattaatgtcctgcatgtattcttttgtaagttctacgacaatgacggagatgtaatcataaagcttgatattgaattggtggatgcgttcttcgatggcatccttgtcatataatttttcattcagcagggcgatcaggaacgactccgccagtggagaacttggggtgtaagtgttggtggattccagcagaaaataaaggatgctgtttcctaacgcctccacaatctccagatccgaatccgatataggcttattaagggccagcacctttaaataggcgactggctttccgttatctttaatcttgtataccagttgatcatggttcaggattcctttttcccacacgaaatctgccttagagccgccgcttagatcttccatcatatccatgtggatctgctcgatatactggtcggttacatatcccttgcttagcgtccattcccacaaaggctcctgggtaggggtattgcctcctgcatgggcgataaagcagagcgagacatccacaagaagaagcggattgcccaggatctcatatcccaggtccagcaattcctgcagggtcgttttgcttttcttcactttcagcagtttcaatatgctttttgaggtacggatctcctcctccagcagtttccatactgtgttgcacagggaaaatgtgtctgcagtcccggagacggacaccagggtgcagcctgcttccggccgcatataggaatccggaatggaagtccctgcaaccaggaatgagatctgtcctactggcggaatctcaggcagatctttggcatttccgattaaaagtatgcccggctcggtagatatctcttctttattaaagaaccggacggttgaaatcggataattacagtccagaatcacttccggcgaataatgctccagctgtcgtaccagttccttcagcgataatgacattggtaaagcctccttccttagactaaccttcattatactgatttgacaataaaaagacaatggaagaatttgagaatttcattttattgaaaatatagccagttattttgttcaattttgcaaaagcatttttcatcattcacaaaaaaactattttattttcaaaatccttgataatgatttaacaataaaaatgcattaggatataagcatagtgaatcccaaagaggaattaaggaaggagaaaaaaatggacaacaaaatgaaaggcagaatcaagattagtatttatgccatagcgcttctgatgatgggggttatcggaatcaccagcgcattggcgaccataggagcgaatttcccggatgcgtcccagacgatgatccagaatcttatttcgatcccatgttttgcaatcataccgacaacaatcattgtcggcaaactgatggagactgttccaaagaagatcatcgcggttgtgggggcggcatgcttcttagtgggcggcatcgtgccagcattcatcacatcgtcatttgccctgatcttagtaatgcgggcgattctgggtgtaggcgtgggcatatcccaggttgtgagcacggctctggtagcagataatttccagggcgaagagcagcagaaggttcagggaaccttgcaggcatcccagatgggcggcgtggctgtcatggtattcgcaggaggatggctggcagatatccagtggaactatgtattctatgtacatatcctggcgatcctgacgctgatcgctaccttattcattctgccaatgcagaaagtcacagtgaaggagaatgacgcgaaagaaaagcattccgtacatctgacgaaggctacctggctgtgggtgctcttcatgtttggaatctttgtatcaattcaggtgtactccatcttcctgtcatttctggtagaagagcggggacttgggacagcagcggactctggcctggggctggcattcttcgcgatcggcggcgtgatcatgggactgctgtacagtaagctggttaaggcttctggaaaatgttccgttgcgatcggatgcctgatgctggcagtatcctatttcatcatggcatttgcaggaagcatgatcctgtgccacattggcagcctgatccttggaatggcagtatccgtaatcgtaccgggcgttatgatctatacggggcagacggtagacgcgttctctgtaggcatggcaatctcactggttacctgtgcgcagaactttggacagtgcgtatgcgcttacatcgtgaatccgctgacaggaatgttcagcgatggatcgaatgtcaactttgtagcattcatcttagcaggggtgctggctgcagtcctgacggtgatcatgctgggatggggaatcaaggcaaataaggcggatgccagataatattaagaaagttaggagatgacaacatgtataagaaactattttcagccaagaagattggctccatggaggtgccaaacagaattgttatgactgccatgggcaatcatatcgcaaatgaagacggtaccgtatcagaagcagacatcgctttttacggcgccagggcgaaaggcggcgtaggcctggtgatcacggaatgcgcatgtgttgattttgcgacaggaaagggtaatttaagacaaatatccgttgatgatgacaaatatattccaggacttaagcggcttgcagatgaagtacataagtatggctcttgcatcgcggtgcagatctatcatccgggacgccagggcattgcggaaatgaatggggtagagagcatgaagtctgccagccagacggagtgccagtgcgtgcaccagccaacccatgagatgacgacagacgagattaaagagatggctggcttcttcatatctggcgcgaagcgtctgaaagaagctggagtagatgccgtagagctgcacggcgcccatggctatctgatcggccagttcttaagtccttataccaacttaaggacagacgagtacggcgggaattttgagaaccggatgcggttcctggatgagattatcgatggcatccggaaggaatgcggcgaagactacccgattattgtgcgttactccgtggatgagcatatggattatgcgggacatccagagtgcgggcttcatcttcaggacggcgtggagatcgcaaaacatctggaagcaaagggcgtagacgcgctggatgtaagcgctggaatctacgagaccatgaatgtggcctgggagccggtaggtttcgaccagggctggaagatggaagggcctcaagcagtcaagaaggcggtacagatccctgtgatcggtgcgtccgttatccgggagcctcagtatgccgagcaggttctcgaagaagagaagtgtgattttatcggttctgcccgcaccttctttgcggaccctgactgggcggtcaaggccagggaaggaagagaaaaggagatccgcaaatgcatctcctgcctgtactgtatggagactttgatggcggcagatttaagtccggttcctatgggctgtgcaatcaacttccagggatgccgggaatcacagtataatgacgacacgcttaagaaggacggcaatggaagaacggtggcggtcatcggagcaggcccggcaggaatggaagcagccagagtccttgcaatgcgtggatttaatccggtagtgtttgaaaagcaggaacaggcaggcggtcagatcgtgctggcttccaagcctcctaagaaggaaaagacaggatggctggtagagtaccagaagcaccagctagagaaactgggcgtggaggtacgcctgaatacggcacccaccatggaagaactgaaggcattagagccttatgccgtgttcgtatcccaaggatctaagccgatcatgccgcgctcgatcaaaggtattgacggcgagcaggtttatacgcctgttgagatcctaaatggcagcgtaacgctgaaagataagaacgtgtgcgtggttggctccggcatgacgggcatagagactgcagaactgttgtgcgagcagggaaataaagtatccgtattcgagatggccgacgacatagggcctggtatcttcttccagaacctgattgatgtattgggacgcgtcaattcttatggtacaatgttatatccgaagcaccgactggtggaactagacggcacaaaagcggtatttgagacgacagacaccaaagagcaggagagttacgaattcgacgcagtggtagtttctcttggaacagcatccaatacggagttaaaagaagagattgagaaggaattcgagaaagtggaattcttaggagacgccctgaaagcaggaagaatcgagaatgcgatccgtaccgggtatctggcagcggcagaattagattaagaggaggaagcaagatgttaaaatcaggaacatatacgcaattagcaccaatattatttggaaatggatgtgcaggccaggcaggagaggcagtgggaaatcttggatgcaagaaggtcctgctggtcagcgatgagggagtccttgcggcaggggctgtggaaacggtaaaaaaggcccttttaggagcgggaatccaggttatcgtgtgggcagaagctcagacggactgtccggaagatacggtaaaggccgctgcggctattggaaggaatgaatccgtggacggagtcgtcggcgttggagggggaagcgtgctggatacagccaaagcagtatccgcggtaatccccaatgacgatcaggtgctggatgacatcgtcttatatctgagcggacagaagaattacgcgaatcagccgctgccagtgatcgagataccaacaacggcaggtacaggctctgaaagcacgttcgtcgcagttgttacttccgagaagctggactgcaagatcgggctaccggttcctcctgcctatggcatcgtggattcagaactgacaaagacggttccttcatatattacggcatttactggaatggacgcgctttcccacgctaacgagtccctgacggaacagacgaatacgccgcattcagacttgctggcttatgaggcgatccggctgatcaaggagaacctgcctctggctgtggaagatggaacggatatggaagcaagagacaggcttgcgttcgccagcaacatcgcaggaatctccttcaatgaatcaggagtccatatcggtcattccgcggcccatgcgctgggacatctatatcacataccgcatggcgtatgctgcgcgaatatgacgccagccatcatcaagtttgcggcaaagacctatccggagaagatgaagaagttaggaaatatcatgggagccaagattacgtcggatgacccggaagtaatcggaacccaggcagcagacgcagtccgtaagttcgcggcttccatcggcgtaaagaccttcaaagaactggggctttctaaagatcaggtactggctgccaagccgatgttctatggagatcctctgtgcatggcattcggaggggaagttacggaacaagatgtgacggatatcctgacggatgcatatgaaggctaggaaaagaggtggatgccatgttaaaagcaggcgaatataaacagatcgctcccgtattattcgggagcggcatgatcgaaaaggccggcaagaaggcaaaagaactgggcgtgtcccacatccttctggtctgcgatgacggcgtgaaaaagacaggccttgacgccagggcagcaaaaatccttgagggagacaacgtaaaggtgacacagtggagcggcgtgcagaccgactgcccggatgagacggtggaggaagcagtcaaaatagtcacggacaatcaggtagacggaatcatcggcatcggaggcggaagcgtgctggacacggcaaaggcgatcgctgctacggctgcaaatggaatcggaatcctggatgatatcatctcttatcttgcgggggagaaacagtatgagaatcatccgctgcctctgatgctggttcccacgacagcagggacaggatcggagagcacctttgtggctgtcgtgacatccagcaggctggatgccaagatcgggcttccatgctctgccgactgcgccattgtagacccggaactgaccatgaccgtaccgccatatgtgacggcatttaccggacttgacgcattgtcccatgcaaacgaggcgcttgccgagaagaagaatacgccgcattctgatctgctggcttacgaggtaatccgcatcgtcaaggagtggctgcctgtagcggtggccgacggcagcaacaaagaggcgagagagaatctgtcttttgccagcaatctggcaggaatcgcgttcaatgagtcgggagtgcatatcggacatgcttgtgctcacgcgctgggacacctccaccatattccgcacggcgtatgctgcgcgatcctgactccggcagtaatccgtcttcaggcattgtactatccggagaagatgaagcagctgggaaatctcatgggggcagagattgtttccgacgatccagaagagattggaaggaaggcagcagaggcggtcaggaactttgtaaaagaagtggggattccgtctcttaaggaacagggatttaccaaggaacagattatggaagccttgccggtggtagagcatgatcccctggcctacgcatttgacgggcaggtgacggaagatgtaatcaagaacctcctggaatatgcctataacgaagagtaaaaacgtaaaattgtaaaaccgagacataaatcatagtataaatgtatcaaaaagaaggtatggactgcactattttgtgcggtccatacctttttaaatattccgaacgatcagcttggggttaaagtcaaaggagacatccagcgagggatcttttattttctccagaagcctcatggcggcatattcgccaaactgctccttgggatgcgcgatggatgtaaacttctgctcttccgagatttcggaattatcaaagccgcagatgacaatgtccccaggatactcgctgtgggattgcaggtactttctcaaagaatgggcaaggcggtcatcgtggcagatgatggcagagcaggaagtaagtgcttttccaatcttgggatctaatggatcggaaaatacgtccggaagattctcgctggcaaaccagaagatattctggtctataatgggcaggccggccttctgataagcctttacgtagcccagatacctgctggtccccgtctgttcatccgacttgcagaaaatggctgtatcgcggtggccgttttccagcaggaattcggcgagtttcatggatccggcctcatctcccatggttatggaagagagaggaagcgtaggaagcttcgcatggatcaagacggcaggcttggtgtgggcgattttctggtagaggtcatagtttaattgcggaagggcggacttggtaggctcgatgatcaggccggcaaagtcgccctcaaggaaattcttcagggcattatactcctgggagatgcagttgttggtaaactgtatgacagaagtatacccctctttattcaatacgctgttaattccctttacgatggagggaaagatgtaactgtcaatatcattcataagaatgccaatgcgcctggaatccctgccaacgggagaaggagctggcttaagggaagtgcgcacgtaagtgccgcttccttttatcttgcgcaggagcgactctttttccaggacagagatggccttgcggaccgtatccctgcttacgccgaattgcgccgccagttcgatctctgtgggaatccggtctccgtccttatatgtccctgatttaatctgttctttcagccatgccgccaagtgcgtatatttgaaacgcatcataagtatacctccaaacattttctgtttaatctatctgttatcatacaacaatttcccgataaaaacaattgccaattctataatttgtatgtatatagtcaataaaaacatacaaattaaatgtttaaactagacaaatattgattttatcatacataaaatacgacaaatatattgaaaatacagaatttgtatgatagaatggcgacaacatcaaatgataaacaattaacgagcattgaaaggagacaattaagaaatggaagaaatgatgaatgcgattgtgttttcaggagttggggagactacctatacgaaggttccaaaaccgaaaatacagggaccaaatgacgtgctgatgaagatcgaggctgccagcatctgcgggacggatgtacatatactgtcaacgccgccatcctatccggcgaaccaggggatcgtgcaaggccatgaatttgtcgggcgcgtggagaaagtaggcagcgcggtgacgactataaagcccggagacagggtggtgctggatccgaatgtgttctgcggggagtgctaccagtgcaagaaggggaactttaacatgtgcgagaatgtgtatgtccttgggattacagacaatgggggattcggggaatatgcggtggctccctgcaagatgtgcgtgaagatatcccaggaacttccggcagagacggcgatatttgcggaaccgctcacctgcgttgtcagcgcggtcaataagatcaggctgctgccgggagaaagcgtgctggtgctcggggcaggcccgatcggattatattttacgatgcttctgaaagccaatggcgccggaaagatcatcgtatccgagccaaatccaaagagaggggaatacgcgcttaaggcaggcgcagacagagtcatcaatccgcaggaagtagatctggtggaagagatcctgaaagagacggatggacatggaatcgatgtagtagccgaggctgtaggaacgctgatccaggaagccgtggactgcgtgcgtccaaaaggaaagatcgtgctctttggcatggatagttctaagaagcccgaggtagaccagttcaagatcgtaagaaacgagatagagatctatggaagctttatcgggctgaatacccttccagcaaccgtggaactcatggaaagcggattgatcgacttgcagcagctgattacgcaccgtctggcgcttaaagactttgacattgggctaaaggccatgagagacggcagcgctttggaggtaatcttatatccggactgggatgagaagaaatagacagggaggaagagagtatgagcgacacaattacatttgcgtcagatgccagcaaaaggagtgtgaaaaactgggcagccaggctggtccttctggtcattgggctgtttatcgcacattttggcgtagtcctctttgtgcttgccgagatgggaacagacacctttaccattttcgtccagggcgtatcgaatgttgcggggttgtccattgggacctgccaggtgatcatcctgacggtaatgatggtgctgatggcgttatttaccaagggctatgtaaagccgggaacgctgatctgcgcattttgcggtggatggcagatcgatctgtacatgtggcttctggatggcaagctaagcgcccagtcgccgatggcaatacggattggggccatggtagtcggctgcgtcatcatcgcgctgggaaaagcagtggtgatcatgaccgatgcgggaagcggccccaatgacctgttctcattgatcgtatcggacgcgatcaataagcgcaagaagatagagttccgctggatccggatcgtgacggatattatgtttacagtcgtgggattccttctgggcggagtgctaggcatcggaacgctggtaacggcattccttacaggaccgatagtccaggtattccttgcgccatgcaggaagctgacgaatgcggtattggcgaaggtagaggggaagaccgtggatgagatgctaagccaggatcgggcggagcgggaagccagggcgtaataagtaaatagtgcaaatagaatcaaatacttttcaattatgataggatataggaggaagatacatatggcagcattaaaaatgatggcaacaccaatcaagttcggaccggtagaaattaagaaccgattcatcgtgtccccgatggttatgaactgttgcaacgaagatggtacagcaactgaaaaatatattgcgtaccatgaggaaaaggcaaaagggggctggggattgatcgtaacggaggattatgcggtggatccttccggaaggacctatcagtatctgccgggcctgtgggctgattaccagattgcgtcccacaaggaactgacggagcgcgtgcatgcggcaggagccaagatctatgcacagatattccacggcggacgccagacagaagaatggatcataggacagcaggtgtgggcgccgtccgcaatcccatgtccggtgaagaaggcattgcctcacgagatgacgacgcaggaagtagaagagatggtggaaaagtttggcgatgccgcgcttcgggcgaagaaggccggattcgacggcgtacagattcatggaggccatggctatcttgtctgtgaatttgcttctgcctattcaaataagagaatcgataaatatggcggcaatctggtaaaccgcatgcgctttcctgtggagatcatccaaaatatccgtaagaagtgcggagaggactttggcattgactataagatctcaggcgaagaatgcgcgccgggcggaaccaatattgaggataccaaggccatggcgatcatgctggaagaagcggggatccattcgcttaacgtgtccgtcggcgtctatgagacctggtatatgcaggtgcctccgtcagtgatgggacatggctggattgcggattatgcggcggagatcaaaaaggtggtagagattccggtgaccacggtggggcgtgtcaatgatccgctggtagcggagggaatcatccgaagcggcaaggcagatgcatgctatatggggcgcgcttccctggcggatcctcatatgccggaaaaagcgctcaacggtcgctttgaagacatcatccagtgcatggcatgccttcagggctgtacgtccaagatagacagtggctgccatggacagtgcacgctgaatccaaggacggtaagagaagatgaagtaaagattaccccggcgcaggtaaagaagaacatcttcgtggcaggaggcggcccatcaggagcggaagcggccatcgttctggccaagagaggccacaaggtaaccgtatttgaaaaagaagaccgcttaggcggcatgtacgggacggctgctgttccgccgtggaaaggggagatctcttcctttgtcgtgtggcagaagacccagctggagaagctgggagtagaagtccgctatcagacggaactgacaaaagcgatcgtggaagaagaaaagccggacacggtagtcgtcgcgacgggaagccatcctttcgtgccgccgttcccgggaaaagatcaggaattcgtagtcagcgcggttgacctgctaagaggcaagattcaggcagacggcaatatcgcggttatcggaggagggcttgtgggaggcgagacggccaatttccttgcgacccacggcaatcaggttacgatcatcgagatgcttgcgcagatcgtgggggaagagccggacaatatgaaacgcttcctgctgcagtcctttgaagaccaccatgtggatatccacgcggggacggcggtacagaccatcaacgaagaccggacgattacggtgaaggcaggagaagaagagaaggttctcgggccattcgataagatcgtaactgctgtgggcatgcgcgctaatctggaattaaaaggcacgctggaagacagcgtaaaagaagtcgtgtatgtaggagacgccctgaagccgggcaacgcgctgaatgccatcgaagaaggctatatggcggcgctggatatataaatgatacgtcccaattattaaaacaaaaaattatggaaacaggcatgttgcgaaaggcagcatgcctgttttgttaagaaaaatcaagagattaacattatttaacaaatgggcatgttaaaacgaatgctttttattaaaaatgtgaaaaaatgttaatgtattacgttaaaatttgttgacatatgttaaaatatgttgtattctgagaacagatagcaacggatatgttagcgctaaagattcgattgttgtacatgccaattacaaaaggaggaaaaagaatgaaaaaatttatatctgtgctgattgccttgacgatgctgttaagccttgcggcctgcagcagctccggagaagagaagtcaacggataaggaagcaaagaaaagttccgacagcgactatgagattgcggttgtcgtaaaggttgtcgggatcgactactttagtgtatttgaggagggcgtgaagaaatttgcagacgagtttggcgtaaatgcgtatgtgacaggcccgtcttcggcagatgcggcggagcaggttaacattattgaggatttgatcaattcaggtgttgatgccatctgcgtagtaccgaatgacgcaaccgtgctggagagcgtacttcagtcagcacaagataaaggtattaccgttgtcacaaccgaatctccggatcaggctggtgcagattgggacgtagagatgatcatcaacgatatgttcgcggaactggttgccgaggaagcagctaagaactgtggcggatccggccagtatgcgctctatgttggaagccttaccgtgccgcttcacaatgcgtgggcagaccatgtggaagagtaccttgccgataagtatccagatatgagtctttgcacggacagaatcgcatgtggagaagatgcggccctcgcccgcgagacgacgctggaccttctgaagacctacagcgatctcaactgcattattggctttggctcccagggaccgatcggagcggcagaggctctgacggaggaagataagattgatgatgtaacagtagttggaaatatcattccaagcgaaggatcacagtatcttgagagtggcgcgatcaaagcaggcttcctctggaatccggctgattccggatatgcttcctgctacatagcaaagacgattcttgacgggaagaagatcgacgattccttctctattccggacatgggagacatcgatctggatggaacgaatctgtggattgacaatccgattacgatcacggcagacaattgggagagttttggattctaagacagagactgcactttctagaactaagggagtggttgcggaacaccgcttccactcctttttgcaaaaagagggatgacatggaaaaaataattgaactgaaaaaagtgaacaagcattatggaggcgttcatgcacttaaggacgtggatttctctctgaatcaaggggagatccactgcctgatcggccagaatggatgcgggaagtccacgatgatcaaagtaatctccggtgtcattggcgtagatcccggcagcgaggttatcctggacggaaagaaatcgacaggcggcctggcgcggcaggcgatggcggcaggcgtgcgcgtgatataccaggacttgagcatctttccaaacctgacggtggcggaaaatatcgcgtttgaccagcacgtggacagcgctgtaaaaggcgtgaactggtccaggatgtataagaaggcgcaggaggttctggaccggatgaagattcagctggatctggatgtgctggtggaagaactgtccatagcggaccggcagctggtggcgattgccagggcgctggcgaccaatgcgaaactgctgatcatggatgagccgacttcatccttgacgcgtaaagaagtgaatgtgctctttacgattatcaaaagccttcaggctaaggggctgacgattctgtttgtcagccacaagctggacgagattatcgagattgccgagcggatcacggtcatgcgcgacggatgcatcatatctacattcgagaacacagacgtgaaggaagaaaaacttgcgcagctgatcagcgggcagcagattacgtatcagcagaaatttacagagcatgaggaagagacggtactggaggtagagcgcttaagccgcgcaagacagtatgaggatgtctcgttctcagtcaagaagggcgagattgtggggatcatcggacttctgggagccggaagaacggaacttgccagttctatcttcgggatgaatccgccggattccggaaggattctcctgcatggcaaggaagtgaagtttaagagcaaccgcgacgcgatcgcaagcaggatcgcatacgtcccggaggatcgtcttctccaggggcttgtgctgaaccagagcgttgagaataatacgattatttcaattatacagaaactgaaaaataagatagggattctggacaagaaaaaatgcacctctatcactcaaaactggattgatgagctacatatcaagagcgcgaagccggagattaacgcgtcagccatgtccggcggaaaccagcagaagatcgtaatctccaagtggctgtctacagagccggaggttctgattcttgatcagcccacgaacgggattgacattgctgccaaaaacacgatatacgagttgatccgggatttgtcggcgaaaggaatgagtatcatccttatctctgacgaggcggcggaagtctattacaactgcccccgcgcgcttgtgatgcataagggtaagatcataaaggaattggattgcagcgccattacagagagtgaattcagccaggaggtgcttgatgaataataaagcagtaaaaaagatttcaaagagttatgaatttatggtgctgtgcgtcatagtcgtgctgattatcggcctggcggcggctaccaaggggaaatctattcaattaggaaatattttagacttaatgacaaactactccgcctacggggtgattgcggtgggatgcctgttcgtgatcatctctggaggaatcgacatttccttcatggcggtaggcgcggtggctcagtacctatccgcgctgtatatgatccacagaggcggcaactttgtgatgatctatctgatcgctatcgtgaccggcaccttattagggtttatcaacgcggtactggtaaacaggctaaaggcccctacgttgatcattacgatcggaacgatgaacgtgatctatggcgtgatgatgaaggtgaccagcggcgtccggctgcatggcttcccggagtggttctccaagaaggtggaatcctctttattcgcggtttccgtgggaacgcttgcggcagtcatggtaattgcctggtttattcttaaaaagacaaaaatgggacggagagtgtacgccgtgggcggcaatatggaggcggcaaaacggtgcggaatcagcgtgctgcaggtgcacatgtttgtgtatggattcgccggcgcgatggcagccatcggagcgctgattaattgttatctctcccagcaggcatccattgaggcgctttatggcaatgagatggatgtcctggccatggtagtcctgggcggggtatcgctctcaggaggaaaaggaagcgtatcaggcacgctgcttggcatcatattggtggcgcttctgagtaacggcatgattcttgtaggcgtatccagctactggaaggatctggtcatcggatcggtcatcctgatcagtttctgcgtgactggctggagaatgatatcggcaaagagaagggagggataggactatgaaaaagtatgatgtaaagtctcttgcgaaacgcggcggggacagtacgatgctgatcgtcctgatggtgattctggtcatcttcttcagtgtcctgaatccatccttcctatctgccaactccttctcatccatcatgaagcagattccggagataggactgttcacgatggcgatgatgctgcctatgctggtgggaggcatcgacctgtcgatcatcgcatccgcgaatctggcatccatcctcatgtccatgtacatgaatgcccatgctgaaaaaggggagacaggcatagcccatgttctggtggcaatgctgatctgcatgctggtctgcatgctggtagggctgatcaatggcgtgatcgtggcaaaattccagattcctgccatgctggtgaccctgggcatgcagatggtgctgactggaatcgcgcttggtattaccaagggaggaaccttgtccggctacccggattctttcaaatttatcggaaacggatatgtgcttgagatcattccggttcagtttatcatttttgtaatcgtatccgcagtgctgattgtagtgatgcagaagacatcctttggaatccggctgcagatgtatggctccaacaaggtgtctgcccagtattccggaatcaacgagatgacgcttctgatcaagacgcatgtcgtgtccggcatatacgtcggaattgcggcgatcgtcatggcagcgcggcttaattccgcgtccgcgggagcagcgggaaattatctgatgcgagcgatcctgatcgcggtgcttggcggcgtggatcccaacggagggaaaggaaaagtgtccggcatactctgggcagtcctattgttccaatgtatggccacaggacttaacattttacgtgtgaactcctatatcgtgattgcgctttacggcgtgatcctcctcttctcggtagcggtccgcacacgaaaggagtgtgcgtagatatggcagaaaaattgaatcttctggcatttgactgtgggaacagcagtattcggacgatcctctgtcagtttgacggagggaaggtggaaagtgaagtcatcctcaaagagccgaaccggattattgaaaaagacaggctgttctattgggatatgatggagattttcaataccatgaagcggggcgtggccttggcagcggaaagaggaaagattgactcggtgggtgtctgtacctggggaatcgacttccttttgctggatgacaaggagcagtttgtccaggaggcgctttgctaccggaataccatcggtgccacccaaatgggtgcccagacggaggaggagcagcgagaaatgttctaccgcacgggaatcctctgcgataagatcaacagcgtgtacatgctgaaaggcatgcagaactatatgccggaggcgatggagcgggcaaggaagatcctgctggtgccggatatcttcgtgtatctgttcactgggcggatgatgaatgaacccagcgaactgtccacatcccagatgctggatgtgcgcaccttaaagatcagtcaagaacagtgcaattatgcgggcgtgtcgccagaactgttctgcgagatcggcgggcatggcaaatttgtagggaatatcaagaaagagattcttaaagaactgggaatctcctacgacattccattcgtgtgcgtgccgtcccatgatacggccagcgcggtgatggcaattccgagccgggaagaggactacctctttgtaagttcgggaacatgggcgctgatcggagcgcagtgcgccggaccgatcgtgaacgagaaggtattgaatgcaaaactgaccaacgagataggcgcttttgggcgaaccactctccttcgcaattccgcaggcatgttccttgtgcagcggctgaaggaagaatatgaggcagagacaaaagtgcagatggactggggagcgttcacggccctcgcggatcagtggataggcaaggtgaagatattcgatgtgaatgacgaccgcctgttcaaccctaggaagatggtgagggagattcaaagcatgatccatccggaagcagcaaacggtacccatgagtggccggagattctggcatctacctacatatctctgggagagagttatgcccaggtgctggatacggtgagagaatgcaccggggattcatatggcgaggtatatatagtaggcggaggctctaagaatgcgatgatcaaccagcgctgcgccgaccggatccagatgccggtggtggcctgcgatatggaatgcgcgtccattggaaacgcagtggtacagatcgcgtatttccatcccgaatattcctatgaccggcttcgggaaatcgtcgtctcatcccttaaagttaagcgttatgagccggcaaaataagtaaataagaaaatggaggatttaacatggactataaagagtatttggttgaatgtggaaaaaagatgctgcactcagggttgacagtagagacgtggggcaatatcagcgtgagaaatccggagaacggattatattatttgaccccatcgggcatgccttatgatataataaggacggaagacatcgtcgtgatgaacagggatatggaaattgtagagggaacctgcaagccgacgattgaatatggaatgcatataggtattatgaacgcaagagaagatgtgaacgcggtgattcatacgcatcctgtggattctcaggtgtttgcctgtctgcacgaggatattcctcccgtcatagatgaggcagcacagcttctggggggcacggtgaagtgcgccaaatacgcgcttccgggatcagatgaactggcggcgaacgtgatcgaagcgctgggagatggcgcggcatgcctgatggcaaatcacggggctgtctgcgtaggaactgacatggatacggctttccgggtgtgtaccgtgctggaaatgacggctaagatctataccgcggcccgtaccattggaaaaccggaaccgattgctgacgataaagtcgcatttatgaaggactttgttgcgaatcactacggacaggggaagtagagagcccgatcatacctaatgtgcagggaaaaggagtataatctatgaaagaaatgaaagaattgccttatacgaggcagaagagaatcctggaaagactgaacaaaaatgattgcatgacaatcaatgagctggccaaggatttcaatgtctcgcagatgacaatctaccgggatattcttcaacttgaaaaatcaggcgatgcactgcgggtatatggcggcgtaaaggccgtggataaaaaagaacaaggcggggaggaagaagcattaaagacatcctcgattcttcgcccatactgcgatgtgacgatcgaggagcgatttaacaagcagatcgatgagaagcgggcaattgcacgggtggctgccagttatgtaaaggacggggatgtgattgccatcgaccccagcaccacgacccttcacatgtgcagttatctgcagaaccggaagatcatcgtggtgacgaccagcatcagcgtagcgctgcagttcgcgtcttccaagtcggtggatgtgattctgtgcggcgggatgctgagaaagcgttcgctggctatcgtaggaacctttctgccggatgtgctcgatcatctttccatcaacaagtgctttatctcatcccatggatttacctatgaacagggcctgacggatgtgacgatggaagaaagcgacgccaagcagcagctcatcagccggtccagcgagtgtttcgtgctgatcgatcataccaagatcgggaaatgcggcccgttcgtggtatgcaacatgggagacattgattctatcattacggatgccggcgcgcagagatccaaggaaaccaagatgatcatggaccagtgcgcggataccggatgcaaggtgatctacgcgaagaagcggggagcggcggaagcgagagagtctaaggaaccggcggcggaagagtagttttttgccaatacatttgccgtactttttgtgacgaatgtccgtaaatctgtttagtccagaagtagaatggaaaaagataaaacaaaatttcctttttatatttaacaagatgggatatacttagaaaaaggacagaagggaggaagattgatgtcaataacgatgaaaaaaatactattacaatatacagaattgttgcgatttatatatggaaatcatttaaatgcagttattttatatggctcttatgctcgaggagattatgatgaattttcggatgttgacattatgattcttcttaatctggatgagatggaacttaagagatatcgacatcagttgtcagagataacatttgacttcaatatggaacatgacgtagatattaagcctatcacaaaaagcaaggaactatttttaaaatggcaggaatcttatccattttataaaaatgttagtcgagaaggggtgacactatatcgtgcggcatgattacaataccggaaaatagaatatcgaaatgtaataagtaattatcaattgattccggcagtgagaagattaaacagatactttaaattgcgaataagctttctggcccctgcatagattgtaaaaaacaaactatgcaggggttattaatatgaaggattatattgaggagagggcagtagaaatagcatattatatcattgagcacaaagccactgtaaggcagacagccaaggcgttcggcgttagcaagtctaccatacataaggatgtaacggaacgcttattgaagatcaatccgtctctggccgcacaggcgcgcaaggtgttggacatgaataagtcggaacggcatatccgcgggggcatggctaccagagagaagtatctgcatcagcatgggcaggatgcagtcggaacgagtatctgagaaggagtgggagattgcgcaaatctccttctttttttctgccctgctataagcgcggaagaagcaatgccaggaaaaatttgtccgcaggcggccaatatgttaaaatgtagggactactattagtgatagcaacactacaggaggaaaagccttgagggacaagataagattcctgtctgcggcattggcggcgatgctggcagtatccctggcggcggccggccttggcggctgcgggaaggaagaagagataaagcagaataagaagcagcagctagaactatggtattactgggatatggcttaccagcagaaggtgctgggggatctgattgatgaattcaatcattcccaggatgagatagaggtgaccaccagatatataccagacgcggattttaaaaaggaacttgcgcttagcatgtatgagggaaccatgccggatattgcgctggtagattcggcagacttccaattcttccagcatacacagccctttgcggatctgacggatgagatcgaagggcttgcggactatctgccggaggcattggcgccatgcgaggaagaagggcggatcaaagggcttccatttggagtgaactgtgtcgctttattctataatgaagaaatgctggcaaagcgcggattaaatccgccggctacgtggcaggaattctacgatacggcaaaggcgctgacagcagatggagtctatgggtatgcccagccggctctggagagtgaagagagcatgtattcgttccttccggtgctgtggtctatgggcggggatgtggactgcctgaactcccgtaagagcgcttatgcgttccaactgttccgggatcttaccgaagatggcgtcgtaagccggcagagcatcagcctgactcataaggaccttgcccagcagtttgctaaaggcaatatcgccatgatgatcggcaatcctatgcaggtagagtatatccgcaagatcaatcccgatcttgcgtttgatgttacggatatcccgtccatttccgataaggtgacggttctcgggggagagatcttcggagtgacggacggcaaaggaaaggacgctgcaattgaattcctgaactatataagcgacaaggacaggatggcaggatatatggatgatttgggctatatggcggccagaaaggacattttagatgatcagtttcaggaagacgcagttctgcataagtttatcggaatgctttcctacgcaagaaccagagaatttacctatcaatggccagatattacgagaacggtagtgtctgcccttgagcagtctattatcggcgaggaagatgagcgcatcatattagaggaagcggcggatagcatacagaagatcagggagggcggccaatgagaagagagatgacgcttagaagacgcttgctgccaatcttcatactggctaccggaatccccatcgtcctgtttgccctgatatcccaatacaggctgcgcagcagcctgaacgagaatatgcagatgcagatcgacaacaatctgaaccgggcggaccagagcctggatatgatactggataagtacgatacgcttttgtacgacttgtgcacggatgatgagatcattggaatcgtggaagatatcaatcagaagaaggataccctggaagtaaacagcagcaggatacgccatgaattaagccatatctgtaaccgaaatgacggaatagagggaattaccattattacagaggaaaatcaggtcatcttttatgaccggctatcagcctcctccgtaaacagcagctgggcggacaagataagagcgcccgaggtggcaaagggagccttgtaccgggggatgggacagcccatagagtcggggaatgataaggtctatatgttccagatcatccgggaattcgtagactaccgggatatacataagtccatagggaccgtgattctaagcatcaatacggatgtgctggagccggttctggatgctggggagaacgccggcatctacctccttcagaaggggaagatcatagcagcatacaaggatggagaatttggaaagaaactggatgcggcaaaggatgagaaattcctctacaccaggaagatgaacgaaatgagtggatttaccatctgcaatgcccagtccctaaggctataccatcagactttaaaagagcagatcctgttttggatattcatagcagtgggcgcgatcctactactgatggcgctgacatattctttgaccaggccgtaccttaaggagatcgaccagatagcggaggccatgagcgaggcggagcggggaaatttccaggcgcgggtacctgttaccgagaatatgacggtggaggtgcgcaagatcagttcgggattcaatgaaatggtgggccatatcgacagcctgatcgagcaggtaaaggcggcggtagtggagcagaaaaacgcggaactatccgcactggaagcccagatagacccgcatttcctttataatacgctggataccatcaactggaaggccattgaactgggagagttcgaaatcagcgagatgctaggagcattagcggatatcttaagatatacggttaagaatgcaggggcagagacttcgattgaacaggaactgcactggcttgcaatgtacatcctgcttcagaaggcgaagcttggaagagaactccaggtagaagtaaaggtgccggaagaactatatggatacagaatccacaagctgcttctgcagccattcgtagagaatgcgatccggcacggcctgaagcagaaagaaggcgagctgaaactggggattaccatgagatcagcaggaggccagatgcacatcatcgtaaaggacaatggccgcggaatttcggaagatgtcttacagaggcttaatgacagcaaaaatgaagcagatgctatagattcgggagagcatatgggaatcatcaacgtgagaaagcggctgaacctatattatggagatcaggcggacctatattttgagagcgcgctgggaaagtacacgaaggtgcatctgtttatccctgtagtcagccctcataggcaggaagacgcagaaggcagaaaggaggagggccaatgagaattgcggtaatagaagatgaagcgccgatccgggaaggcatgagcaagatcctgaagaagattaacgagaattatgaactggtaggaaaggcagagaacggcaaaaaaggactggaactgatccgccaggagaagccggacctggtaatcctggacattcgcatgccggatatggatgggcttaccatgctctccatcgtgcgggaggaaggcatagagtgcaaggccatcgtcctgagcgcctattcggattttgcatatgcgcagagggccattgaactgggaatcgagaactatctgctgaagccgatcaagatcgcggaactgaagaaggccctggaacaggcagaggcgaatatttccaaagaacagagcaaggagcagctgttcagcctggaatatatctttctgaacgccataacaggccagttggatgaagacgggaaactggcggacatgattaccgaacggtatggaatccgtggggacgagcagatcgccatatttggcattggattaagcgataattatgaacgataccatgagagcgtccgccggacgatggaagaagtaggcattcacagtaatgaattccatgtctacgttatcgaattccaggaaaagggcgcgatcgtcgtcatcctgtaccagctggaagaccaggataaagtaaaagaatactttaaaaagacggtggtcccgatgctgggaagccagatatcgggacggctcagctgcgtctgggggaactgccagggactcttgaacgtaagggaagcagttctggaaatggatagcgtgctggagtggaaccttttctttgacagagggacgctgatcagcaaaaggctgattgacgcgacccagacctatccgatcaagtaccctattgacatcgaggtgcagacgaaggaggcagtggcggatagcgaccgaaaagagttcttaagctgcctgcgccggttccgggaatattgcagggagggagcgtgcacgccccaggatatgaaagaagcatgcagccgctatatgatgagcctgctgcatatggcaaaggaatcagggaaactagaatcatccgtgtctatgcagaatatgattacgtccatatccgacgcgatattctggcaggatatcgaagaagcatttcttacattttttgaaaatctgtccttgaaaaacgtcggggaagatggcgtaagcctgctggtccagaaggccatacagcatatacaggagtactataaccagggcatcaccctggaggaagtggccgccaagctgcatgtgtccgaagaatacctaagcacccagtttaagaagcagaccggcaggacatttaccgagacgatccgtaaataccgcattgaaaatgtgaaggaactgctgctaaagtctacccttaagctcaatcagatcgcggatatggttggatattcggatcccaagtatatgagcaaagtgttcaaggatgaagtggggatgcttccggcagagtaccggaagaagaacagttaaggacaaaaacaggcaaaaaccggaaaaaaccgttaaaaatttctacttttttaaaaaatttccaccttgaggggatgggaaattatgctaagatgttcataacgaaaaggagagattgttatgagcaaaagaatcgttgtatttcaaaatccaagcgatatattagaatttgtaagaaaggtcgagaaatatccttatgacatggacatgaagcgcggccgttatatcgtcgacgcgaaatctctgctgggactcatgaatctcggttttcagaatgagattgagttgaaagtctatgaagaagaatgtgatgacctctggaaggatatagaaaaatatgtcgctgcataagcaaattgatgcttgtgtaatgaaactccctgtcgtataatgtacgatgaggagtttttattatgttaaagaaaatgaaaaaaagagttgacagaagcagctacttattcgacaataaggcgctgcttgcattaattattccgctggtcatcgagcaacttctagcagtacttgttggcatggcggattctattatgattgcgagcgttggcgaggcagccgtctccggcgtatcgctggtggatcagatcatggtcctgctgatcaatgtatttgccgcccttgcaaccggcggcgcggtggtggccggacagtatctgggacagaagaatcaaaaggaagcctgcaagtcggctacccagctgatatggttcattaccctgtgctcggttgtgatcaccttattggtctatgcgggcaaatacttcatcctgcatggaatcttcggaaagatcgaggctgacgtaatgggacatgccaatacctacctgatgatcgtaacggcatccatcccgttcatggccctgtataatggaggcgcggcaatcttccgtgccatgggcaattccaaggtgtccatgcaagtatccatcattatgaatatcatcaatgttggcggaaacgcgatcctgatctacggtttccacagggggacggaaggcgtagccatccccaccctggtatccaggatggtggctgcggttatcatcattgccctgctgtgcaatccgaagcagcttctacatatcgagcgcaccttccgctataagttcaactggcagatggtaaagaagatcctgagcatcggcgtgccgaacggcctggagaacagcatgttccaactgggcaagatcctggtattaagcctggtatccacattcggaacttatgctatcgcggcaaatgccgtgggcaacgctatcgccttattccagatacttcccggaatggcaatatccctggccgttactacggtaatcgcaagatgcgtaggggcaggagactacgagcaggtgaaatattacaaccggaagttgatggtgatcacctatgtatgcatggctgcgaccgtgttcttcattttctccatccttccgctgatcatcaaggcttataatctgtcagacgtgacagccagggcaaccgagcagatcatccatttccatggaatcagcgcgatcctgatctggcccatatcctttacgctgccggctaccttccgtgcgtccggagatgccaaggcatgcatgtacatctccatactgtccatgtggatcttccgtatcgcattcagctacgtgctgggcaaatacatgggattgggcgtgttcggcgtatgggtggcaatggtcatcgactgggtatttagggcactgtgctttgtaatccggtatttcaaaggaacctggcgcaaaagcgcgatcgtgtaaaatgaaaagaagtcccttgtcaacagggggcttctatcatataatagaacctgattttgagagacatatgtgaaacttggatataataggtacgagattgacaaattaggaggaattcttgtgaagagagaattagtaatcgtcattgattttggagggcagtataaccagctggtagcaagacgtgtcagagaatgcaacgtatactgcgagatctattcctacaagacagacctggagaagatcaaagagatgaatcccaaggggatcatcctgaccggagggcccaacagctgctacgaggcagattcgcccacatataagaaagaattatttgaacttggcataccagtcctcggactgtgctacggcgcccagttgatgatgcacgtactgggcggcaaggtagaaagcgctgacgtcagggaatatggcaagactgaagtcatcatagataaaccccagtcgccaatctttgaaggcgtgtcatccccgaccatctgctggatgagtcattttgactacatctccaaggtggcgccgggattcgaaatcaccgcccacacggcagactgcccggtggccgcggccgagaacgcggggcagaaattatacgcgatccagtaccatccggaagtgctccatactgcagaaggcacgaagatgctgtccaacttcgtgcttggcgtatgcggctgcgccggagactggaggatggattccttcgtggaagaatccatcaggcagatccgggagaaagttggcaaaggcaaagtattgtgcgccctgtccggcggtgtcgactcctccgtggcagcggtcctgctgtccaaagcggtaggagaccagttgacctgcgtattcgtagatcacgggcttctccgtaaaaatgaaggagacgaggtagaggccgtattcggaccagaaggcgattatgacttgaacttcatccgtgtcaacgcccagcagcgtttctacgagaaactggcaggagtctccgagccggaggcaaaacgtaagatcatcggggaagagttcatacgagtattcgaagaagaagccaagaagatcggcgcggttgacttcctggtgcagggaaccatctacccggatgtggtagaaagcgggcttggcggagaatccgcagtcatcaagtcccaccacaacgtgggaggcctgccggactgcgtagacttcaaagaaatcattgagccgctgcgcgacctgttcaaagacgaagtaaggaaagccggactggaacttggcattcctaagcacctggtattccgccagccgttccccggcccgggacttggcatccgcattgtcggagaagtgacggaagaaaaagttaagatggtgcaggacgcagacgcgatctaccgggaagaaatcgcgaacgcaggattggataaaagcgtcggccagtacttcgccgcacttacgaatatgcgaagcgtcggcgtcatgggggatgagagaacctatgattacgccgtggccctcagagcggtgaacaccatcgacttcatgacggcggaggccgcggagatcccgtgggaagtgctgcataaggtgaccagccggatcgtgaatgaagtagatcatgtgaatcgagtgatgtatgatattacctctaagccgcctgggacgattgagttcgaatagagggttaaaacctcgcaagccagtaattgtaccgacccccaaaagttagacctaaaaatctaacgattggaggtcggtatttttatggctaaatatagctatgaattcaagaaaaaagtagtccttgcatatttgaatggtgaaggcggctatcaataccttgctaaaactaatgggatttcagattcgaaatgccttagagaatgggttaataactataacgcttttggtgatgaaggtctaatgcgttctcgtaaacaagaaaaatatacttttgaaaagaaactttctgttgtagaatggtatttatcaagtgaaatctcatatcatgagtgtaaacgtcaaaccatccgccctagcctaaaatgacgccgctgaaaaagcggcgtggtttttgacatttttctggcagattgcttgaccatggcatcagatatgccaatgcgtttttatctatagctccatcctttgctgtgaacttgggcaattctgtaagcagatagcagaaataattgtaagtactgaggttgtagtcatcacaatccgagcgttctgactttccatagccaggatggtcatccagttacgtctccatcatttctttgatggttccgccaagcagatctttgagggcatcctgaatatcagttgccgtttcaatgtcatacgcctctagaagttgacggataatgttgcgttttccctctgtcatttgtactttgtgtactggtttcttttctcttgccataataaggcctcctatgattttaattttatcacagaagaccttttatttggttatttacagaaaaagtttcacagactcctgctaagtcttcaatttgtccagtgtgttagcatcaacgtaaatggtacggacgattgccctcggctttggctcaacaaatcttcgtctccgaattgctcacaataatgaacctaatttaaaacttgacatctattttctacactatacttttcagcaagtaatgcgtaaccactttctccgcataagtaagcgtcacaatttgcttcttgaactcataaatatgcttaaccctaaaataccgatcttcaatcgatagattataggcctaacttttaggaggcggtatagttcatactatgccttttaataataaattgataattacctgtctttttcagcagatttcaaaatatattttcggtcgtccaatatgaatatgtatcaataatataatgataaatcccctttgcaatttcctttgcgaattcattttcttcgcctgctcaaattacgatgggatctctaactagaagttgtcccggaagcagtatacacaagcgtcatatcagtttttcttcataaacgcatttttcagttattgccatataaatagatcattccttttttaaagtgttttcataatttgttcaatatttacatgattaaaaatattgttaaaagttgaataatccacataaaaacttttttgtagatgctctttttcaatatatttcaaccactctcgaatagtttgttttataccatcattagattgattagaaacatagaaatgagttccatttgcaagaatatcttggataaaatgtttttgcttgctgtctgcatagtattttttatctaaagaggaatagatgtcgaaccacacatcatgccttgatactgatatttttatgaagccaataatctgattatatttccatacgcaacgtggaaagcataatgttgatataccagattttgcacttttatctgtatgcccatgagagataaacatatcatatattttagcctttttcttatcccaacgcttattaaattctttttcgctcatagcataaattggtatttcaaataaagttttttgttccatatccctattcctttctatccattattttatcatagtgatacaaataagtcttttctttgtgatattattatatcttataagtcacttatgttacaactacactatatcaaaacagaataatagaagacaaatggccttgttacgcctcgtgagactgtcgtctgatagaatttatttatggcgtttatatctgaattagcgcatatttccggtattttacgttcacgagggagcctgcttggaagttccattttgagatgtcttatgttgtgatacagagaaagaaatcgtttgagcgctgatagtccgcttacaataatcgagggttttatatttactgatgaataggacttttcctcgcaatagatcaaaagatatgccgccatccttttataagtgtagatggtgtttgactgaaggctatcttttttcaaagtcatagcgaatgcttcgaatttatttcaaaatgattctgttcttatgctgccgttaacaaaccttcccattacttctggaaacattagtctcccctgtaccaatataagatctgataagactcacgatactgattaggttacgtttcttaagggcagattactcgccagtagacttatttttgttgttattgagataatcctgaaataattcaccacaagattcgtgtatctcattattccgtgcataaaatttttaagattgtgaagaattgtttcagcactacattccttcattttcaaagattcaagtgtaagacgcagggatttttctagtttagtttctttgggcattatgatgcaccgcctttagaggtatggtacatcatatataaaaactgtgcagagtattttctggaaccagcatgcctagcaaattctgataaatattggcatagtactaggaatgcgattgaatcgttgaattacggtaataagatttttatctacattaaaatcatcgagtgcaatttttattgattcacgttaggaattatctcattgatttcttgcttttaccaagcatgaaacaataatatttttcttagtcttatatgcgcaattccttcatttcggttccctttgatttacaacaatttgtatcaggattaagcactttcagtcaatcgtagcacttcatcctaactgattgaaagaagaaatgtaggagagtatataaaaagaattataataaagaaaatgtgacaaagaacagttagcgttagcaggctcatatccgtttatctatagcatgcgagggggaatttagttgtttaagaaaaacggatgtataaaggataatttggaaggagagtaatgaaggagattcaaaatgagaatacaatagtagacaaatatgctaggtaagaagggatatcatatttttttcttagatgatataatgaaaataattacagacaatggcacagagtaatgtgaaaaattgacataatgtgtacgaaaatagtaaaaaaggtagaaatacatatgcaggagataaaatataatgatgggttatagtggaaggcagattgcagatgtttttttgtcatattcgcatgatgacagagaaattgttgagaaaattgcaagcaatattcaagcgagaggatttgaatgctggaaagataaggacaggctccgtgcaatggacccgttcaatgtgcttatcgaagaagcgatagatgaatcgcaggtgtttattgcattcctgtcaaaaacatatgtgagcaaagactattgcattcatgaatttaatagagcgatcgacaagaagaaaagtaaaatagttgtctgcattgatgatgtgaatgagtatacgaacaggaaatgctcatatatgttttctttttcatcgggtcataatctgctgggattcggaagtggattttctacagacgaggagtttagtgctgccgttggggacatctgtgacagtgtgcctatggtccaattaaaaagatatcagactagtggagaaccttctgatctgccgccggcaaatactccagattatattttttcacagttacgactatatcatgaacggcaatatgtacaaagtggcaattatgcatttaatgagattaggggagatctgtttccttctattaaggataccgagatcaacgtcatctataaagatgaagatcagaatgaagtgtcattgattagatatattacagactctcaggatgataggagtaagaagcatattatgctcaccggggaaggtggtatgggaaagacgatatctcttctcaagaccacggagtatttgctgcagaatggcataaatgctatctatgttcctttaagcaaaatagacagagagacacctttagacctataccttgaaagaaatgtatgtggcggaaatcaaaacatatgggagtatttaaaatataccatgagtagtgctgcttcggacaaagatactacaatcgttttgcttttggatggaattaatgaaatcccactggattacgtcgaagattttataaagaaatcaattaaagatgtatatattgacagttataaaggcgtacagttgatcatgacatccagatggttcgattcacagaatatgaatcgttttcaaaataatgtgatcacgttagaaatgcagcctttggatgaaagcgccatcaacaagtatttggaaaacagtggtcttcctgccgcttcccctgaattgctttctgtattgtcaactccgctgttattaacgctttatgcagatgtggagaaacatcgcgagaagtaccagcagatttctggaatagaacttgaagataatccggatacagcaggtaagattctggggaatttttttcagacgcaattataccgcgcagcggaggaggctaattttgatagagaagcacatttggttttgttagaatactggctcccctccgttgcatttaaaatggtggaaaataatagcatgaaaatatctgaagatgatgtttggaactgtgtagacgaactggaagactccgtaagatttgagtggtatagaaaagacaggcttcgtaggttgattcaaggaaggggaagttttgatgcggatagtcttataaatcttgcggtaaactcacttcattttcttcacatgacagacaattcgtatgaattcttacatcagaattttagagattattttgctgcatatcatattgctacagaaataaaagcattaaataaagatactacaagattagataaaattgaactatatattgctaacagaatattgccacatgaaattattagttatatctctgatattacgcatgaagaagaggcgaggcccattttaaatgaagatggatgggtatatccgggaaaggatggtattgctccttcaaaaaacagtttggttgaaaagatactttctctatggagaaacattgagggaggacatgcgcaaactgcagtatataatattctgaatattatgcgtgttggaagaaaggataacctctcgtggtgcgatttctctggattggatcttcgggcatgcaaaatgaatcgatgccattttgtagaatggtataagaacgatttattcccgagcagtttcgatggggcatggattgacaaagagtttttcttgaatagtggtcatgaggcaaatattaccgcggttgaaacggatggtgacgaattggtttttagcggcgatcaaaatggcgttttaaaaatatatgactgcaatgctcatacatggaaaaaaacagtacaattacataatagtcctatagttgatttggcttggaacgaaaaagaaaaggtgcttgctgtcttatataaaaaggtactgttcatttattcacttgagaagttgcaggttattcatacctatggtaatccaaatcgtaataaagagtatcgctacgtaaaatttctggacgattcgatgccgattacttcatatgacttggaaccattgatatggtataagattaacggcgaagtaatgttgccaaatgaaagatttgagtacgatgttcctgcaagatgtgctgtctggcatccatataagaaaatgtttattagaagttatctgcttcaaatgttatccgtagattattggaatgaagaaactgagacatggtaccagcatccagcattaattcagaagagggatgatattaatagatatcgtatgcttaataaggaaaaagccattgataaggcatatttaacactaagggattatggagtgataagcagcagtggtgttaattgcttatgttttagtgctactggagaaacatttttggttgctattcagaatattctgctggaatttgatacgaattcgttaagccttgtaaataagagagtatttaacgagaaactaggaagtgcatgttacgggaaagataagattgttgttggggctgccaatatggtatatttgttagaaacagatttttcaacaattgaagtactttctggttcccagataaaagtaatatcaatgttcacatatgatccggatggagacggttattatgtgttgtccaaaaacggagaattaaaaaaattagataatcaattgaatgttcaaagaatacgtagggtatgtcatgttaacaaatttgcatgggtaaaagatcgtttgacacaagaaaaacaagttttctttctcccatcgagagaatatgaatacggtattcgctattcttatgacaaagatttgtttatgaatttgggctggcgatatgaatttattgatatgacgttaaatagaagcagggaatccaataagttatatttgttggaatcttctcttatgaatgtaggaagcagcgatacctgtgggaaaataatctatacaaattatggcggtatatggatatttggctgtagttataaggggattaaaggggagatggccgaatataaacacaagcggttcattgagcaaaatggaggattagtatatgagtaatagtggaagtactttggatattacgcttcacgattataacatcttagggaattgtctggctgatgtggtccttccattaacaggaacggtggttaaagatttcactgttatgaggacttctacgggcgtggtgcatgtctatatgccgtcatgcatgaaaacaaattggacttatgaagagattgaatggagtgaagtacgaaagcaaatcgctataaagtttaaaagtaatttgccagataagtcatatttggtacaactatatgattttgaaggagacgatgcatgtaaagcaaccattactttgccagaatcaggtgtgcaggtcaatgaattaaaagttaagaaaggcttagggaacggcgttattgttcatatgccatcctggatgcatactcgttggagttatcctgaaatccaatggtcggatgttcggaaacttgtgatagaacagtatcagagagaggttaataaacgaaataatgaaattaaggaggtaaaaaaagagaggatatttgaattttattctgttcataaacagaaagaaatattagttaatattgtacttccattaagcgggacagttgtcgaagaaattagattgataaaagatgatttggatagaatgtggatctttatgccgaattggatgaaacgtgagtggaaatatccggaagtggcttgggatgatatttttgcaagcataaaggaggaatatgcctatagattcgatgctggccatgagcattcaaagtatgcgatagaatttcaagaggaaaaagatgttttgttctgcctggcagacataaaacttcctgaaaagaaaaacatattgaaagggtttagaataaaggaagagatatctggaataaggatttctacacccaaatggatgaaaaggtggaatgattctatatatagttgggatactctttgcgaaatgataaaaaaggcatttatcgagtggaaatcagagcgtgaagggacaccagataaaagcgaagaatttgatcggttggatgaggatagaaaagaggcagaatcccttgaaattgaagagcagtcagagttatctaataacgatacaagcagtttggatgacttggaggccgatgaggatgaatcagatgcattgacctcattatttggcgaggaagaggcagaatgcggagaggagaaacgtgaaaaaaatgaatatggaagaattatgaatgcagaaaattcagcattgaggttctttccacatactgttttacggatagataataataaagaaaaaaagcggatgtacgaacttgttaatgcaatgtctaagggctccatcggaggtattggcccgtttgagataaatattttggaatgggtcagcagattaagatatgtgtcaagtacgatgttattggacctattgaagggtggatatgtgtctactggatggagaaaatcaatatctcaggcgaaacttgcaaaagttatttctagaatgaatctatttgatcttgtgagcatttgcaagtttgtgtcagtagatgaaaacgggcttgccaaagaagatggaagcatgcgatcaataatgcgtatacttacattgggaaaggcaggaaataccatgctgcatgaactgggaagaaatggttcaaaatataatgcatttgatacataccaagatggaaacaccgtcaagaaatacctctccgcaaatcaatggctgatatattggctgactacatatccggctgcaatagatggtaactatgaaacaacagaggttatttatcaaaaaggagctaattttgatggcgcaagattttatgcaaccgtaacatgcaatgattgtacgatggtggctgagccgcaaagaagagtggatgatttcgaagaagagaatgatcagtattggataaagcataaatataatcggttcataaatctattcagtaatcttgatgaactgtatcttggccaggaggaaattagtttttcacagagacccattcttgtatatatttgtgaagatgatgaacatatgcaggaggtgttccaggtacttagtgaaaacataagcagtcatccggaacaggaagtatggtttactacagatttaagaatatttaattataatatggcaggaaagagattccttactccaatagatggaaatcttgaacttgttgatctacagaagactatcggagttagtgatcctttaacagaagtgatataaggctttactgcgagtgccatagatagtaatatgccaaattaaatacaaagaccaggagaaatgcatatgccaaaaggagcaaatcaaaagttcaaactatactacctcatgaaaatcatgctggaaaagaccgacgacgagcacagcatcacaatgccggagatattaacggagctggagagataccaagtctcggcagagcggaaaagcatctactcagatctgcaggcgctggaaaaactaggcgtagaagtcatcggagagcaggtcgggaggacgtattattatcatgtgggaagcaggcagtttgaattgcctgaactaaaactattggtagattcgattcagtcgtccaagttcataactgccagaaaatcgaacgaattgatccgcaagctggagagtttatgtagcgagtatgaagccaagaaactgcagcgtcaagtatatgtttccggaagaatcaagacgatgaatgaaagcatctactataacgtggactcgatacataatgcgattacagaaaataagaagatcatgtttcagtattttcagtggaatctggagaaagagatggagttacggcataatggggagatgtaccatatcagcccatggggcttgtcctggaacgacgagaattattatctggtaggatatgattcggaggatcagatgatcaagcattaccgggtagataagatgcttaagatccgcatgtccgatgagccaagggaaggggaaaagtattttgagaaatttgacatcggcacctattccaggaagaacttttccatgtttggagggaaggaagagcgtgtcaaattgctgatggataatcagatggcaggggtggtcatagaccggtttggaaaagacgtttccatggtaccggtggatgacaatcatttttctataagcgtcgatgtagtcgtcagccagcagtttttcggatgggtatttgcgcttggagagggagcgaagatcatcgggcctgagagcgtggtacggcaagtcaatcaggaaataagaaggttagtcgaacaatataatatggaataagttatagaatatagcaggagcagttccgtttggggaactgctccttttatggtggtatttttattggacacctaatggggtaaagttatgtcaagaaaaccgataagaacgacataagaaagacgcaaaataaaaaacaataagtttggattcataataaggaggtaaggaatatgaaaggatatgcagtagataatggttacatgggttatgtggatggcggctatatgctgttcgccagcgaagtggattatagcgagtatctggatgaagaataaaatatattatagtttaccagttgtagatgaaacttacagacgtaaaaacaattctagatagtaatagaaaagtgagtaacaaaaataggaaaatatgcaatcaactgtgcctgctttcatttctataataatttaaaggataatttgataataattgttctcattgattctagtaatattgcatgtagaatgtaatttgatctcgatttatcatctgtctatgtgtaatgcccttacgtttatcgaaataataaactattatgtaattcatgtgtgaatcacatagggaagactccccatcaataataatgatgggcattttatgattagaaataaatattttatagcgtattttacttcttgttatagtagttactattattaagaatgagaataatataaagaaataaaattttatactatctgttgaataatacttttctattttcatatttgaaaatacatccgaagaaattgctaatgaaaggaatactgcccaaaagcacattaaactttttagtatgaataaaattttttgaggggttattggtgtactggaaatattatctaaaactttgtttaatatcaaatataaaacaaaaagaactttatattctatatacagtattatacttataactagtatgcaggataattttagctgggcagaaagatagttatataaaaataatataagtttactaatgggaaatattgaagtggtagtcaacaagaagaataataatacataaaacaaaatttttaaaaattctgctatacttattagtctatagtagtaagaagttttttttgatatgtaaggaattaatacagaaaaaagaagtgttgttgcaactgatgcaacaaacggtaaaaataaatagtttatgatatctttgatatttactaaaattggcataacaacctccagattatacagggatactaacttaatgatatacgataaaacttgtttttacaataattttacttgtatatataaacaataagggtatggtctacaaaaaagcaataacaattaaagtatagaatttacaacgtgaggaaactcgttagacaaagtgtttttattcttgtaataaattacagatgttaagatataactaatattattgagtatatctacttgattataaacagtgtaattagtataaatattcaaaaaataaaccttcatcaacttgaaggtttattttcattttcccaaagtatcaaaaatcaaacagcatttcaatctcacgtcaaaaatctaagcgatttatccacaaaaaacaaaaaataaactctttctattgtaataatacacaaaaataagaaatttaatttatataaaaggctgaaatgaaatttaatttctaatacagattgacatttaatttcaggattgctatgattatgacataaaatttcaggcaaagccgaaagaaaaaaggaggaatagtatgaaaaaagtaacgttgttgaagaagggcttgtcggcagttctggcgggaaccatggttctggggcttgcagcctgcggaagcggttctggcggagattcgaaggacgaaggcggcgacaagagtgtgacgcttaagtggcagcagtggtgggcagtggaatgtccggaaggctacgtgcaggacattgtggacaagtacgaaaaagagactggcgtcaagatcgaactgctgagcgcgccgttcgcggatacaaagacgcagattacctcaggagccagtaccggaacggtagcggatattgtcagcgtagacagcagctgggtatacgatttcgcggaccagggcatcctgacaaaccagtcggatctgatggacaaggatggctttgaccaggacatcatcgacagcgagtggcaggtagacggctctacatacgcggttccagtcgttaactttgcttatccgatgtatgcgaaccaggatattctggatgaggccggggttacagaacttcctaagacttggtccgaattcgaggcggcatgccagaagattaaggatgcaggctactatccatttgcgctgaatctggatacgacatctccatcaggaatccagaattcttacatgggatttgcatgggcatccggcatcaagatcaaggatgaggacggcaactacaatatcgctgataatgcggatatgaaagcatttgcagagtatatgaagggattaaatgacaagggatatatctatccaggcatgagttccttaacagaggctgatatgtcttctaagttctgcagcggagagattgcgttccatatcaactctgcggctcttcttacttcctaccgcaaggaggctccggacatgaatatcacaggagcgccgattccggttaaggatgactacacaggcgacaagggaatgtgcgttgcaagctgggcgcttggagtaacggaaaagagcgagcacaaggcagaggctatgaagtttatcgaatatctgttaagcggagcggacggaaaagacggatctatctgtgcagacctggcagtgacacagtccgcgttcccgaacagcacgcttgcgaagcctgattacagcggagcagatgaagtattccaggatatttacgatatgtatcagggcggctatccgatcaatgagttcacaggcatgaaggaagcaaataccatcatgacagactacatcaatgaacttgtgccatatatggatggcaagcaggacgtagataccttccttggcaaggtgcagaaagatattgatgaggtatatggcaagtaagcgaacgagaagttagtatccaattgtaatgaaatgcgaaaatggagtcatagttcttgtggctccattttcctttatagaagagatcagatggagtgagataaactgatgaaaaacaagagcggtttaaaattgaaaaaacagattacgccatatttatacctgtctcccacagtgatcttaatgctggtcctgctggtggtccccatctgcctgatcgtgaagtattctttccagaataatgcgatcgtagtggccgaccctgtattcgtagggctggacaattatataaaaatcctggcagacagcgagttcgtgggcgcggtcaagaccacgtttatcttcgtggtagtgagcgttgcggcccatattgtcctggggatgtgcttcgcgcttctcctgaacacgaagtatttcaaatcaaggacgaagaccattgccagagtcatctacgtccttccctgggtattcacggcctcggttatagcgattttgtggaaattgatgctgcagcccgccgggatcgtggattacctgctttccttcctgaatctggcgacaaaggatacggagtggctgagcaatcagagcgtggcgctggcgaccataacttttgtcaatatctggtgcggatatccattttacatgatcagcattctggccggattgcagggcatatcggaagatctgtatgaaagttccgcgcttgacggggccacaaaatggaaatccttctggcatatcacgattccccaggttaagcctatcctgatcagcatcgccatgctggactttgtatggacgcttcaatcatttgcggtgatctggatgatgacaggaggagggccggtcaattcgacgcagacgcttagcatctacatctacaagctggcatttaacagcagccagtatggcattgcatccgcagtggcggtgcttctgctgatcgtatgcgtggccgtagccattttctatgtcaagcagcaaaagaaagcgagggaataggcatggtaggaagttacaagaagccgattaaggtgattttgagtattttactgattctgggcggagccttcgcgggatttccggttttatggatgtttatatcatctttaaagtctaacacggagatattctcctggccgccgacctttattgacaaatcattcagcctgcgttcctatatagagattctgacggatgcagaaaaggtccggtatttcctgaacagttactttgtatcagcagtcgtagtggtgctgacgctggtgatcgggattctggccgcttatgcgttcagccggtttgatttcccgttaaagggactgatcaatacgctgatcgtaagcgtgcaggcggttcccccgatcgtgcttttgatcccgtatctaagcctgatcgtgtcgctgaagctgtttaatacatattgggccctgatcctgacctatctggtatttacgctgccgtactgcatcctgatgatcactggttatttcaacacgctttctacggatctggatgaagccgtcatgatcgacggaggttcccgcatgaaagcgctgtggaagattctggttccagtgtctgtgcctggcctggtatccgttggaatgtataccttcatgcaggcatggaatgagtacctgtttgccctggccctgacccagaccaccaatatgcgtacggtcccgatcggcatcaacatgctgatggggcagcatacctacgactggagccagatgatggcgatgagtttcttaggctctctaccggtattgattctgttcatcttcttccagaaatacttcatcgccggaatgtcatccggagcggtaaaaggatagcaggacgagaaagcaagagagaaaggaaatataggagaatgggtgaaaagatagcattagggttccatacttgcgttgattttgaaatgacttgggacgcagaggtggtggagcagatgatccgggagtttgacgtccgggatgccgatcttgcagacggcgatattccgattgactcggtgcgggcgcttctcatatccagcctgtggcatatgaagcggggaatgggatgcgagctggtgcccgacacgaaccagatctgcctggacttcgctaatcggttccagtaccgcgtcaccatcggcggcacggccacacgggccgcgatcgctatcagcaagctggggtacgagagcgcgatccagttatgctgcttcaaccgttatatgaaggaacttctgccaaaagagatccattatatggtaggcgttcagcatgagagggaagaagtctatcctcatgtcatcctgtcctatcagggcggggtgcgtatccgggcaaatgatattgattttacgacgccccgggagaaccgggtgatgttttcccgggacatcgacagcctgctgatagaagtttctgaacattacgcgccgatgatacaggatgcggaagcattcctcttatcctgcttcagcgagatcctggatgaggagattctggaagaccgcatggaccggacccggaggctccttgggacgcttcccaaggacgccatcgtcgtgatggaggatggatgctatatccgcaaggatttccgcgtctatgtacatcaggcgctgcgggacgtggtggacgttctgagcatgaatgaggatgaactgcaggaatacatccagcgcaggatcgatattctgaatgtggaggaggtcctggatgcggtaagagaggtgtatgagaaggtgaaggttccgacacttctggtccattcggccgcctgggcgctgacctatggggaagatgccagaaagtatgagcgcgccctggaaggcggcatcacgatggcagccacccgcttctggcgaggggatgattttggaaggaaggagtatgaggagacggggcatctggcggcaaaggaagagggacaaagattccgtcaggagattgaaaagcgggcaggggaagcagtctgctgcgttccctgcaaggacttaagctttgtggagaatccgacggtggtcggcctgggcgacttcttcgcgggcggcctgcttccgcagctgactaaggaccggcgcatataggcgcagaacaatggttgataattaaagattagaagaaaggatgattttatgtacgagagagtggaaaatattttaaagatggcagaggagagcaacacttcagccatagcatttatctgtatggatgatacgatggcaagatccgtcgtatgcgcggcggaggcgacgaacacgccagcgatcatcatgctctatccggagcatgtcacgatccagaagacctgtaacctcagcggattcgcagccatggtagaggagatggccaaagaggccaaagttcccatcggcttgcatgcggatcatgattatacctatgacgcgatcatcaacacggtcaataagggatttcgttcggttatgatggatggctccatgaatgatctggatacgaatattgcccttaccaagaaggtcgtagacaaggcgcatgaactgggggccatcgtggaaggagagatcgggcacgtaggtatcgcggcaaatgcggataacaacaaggaggacctgtataccaaggcggatgccgcggaaaagttctgccgggagacgggcgtggattcactggcaatctccattggaaacgcccatggagagtataaggatacgccgaacctggacatcgcaaggctggaggagattcacgcagccgtgaatgtcccgctggtactccatggcggcagcggcattccggatgatcagctcttgactgcattttcaaaaggaatccgaaagtttaatctgggaacagaattcctgggaagatactatgacgcagtagcgcagttcgtaaaagaaaacgccaagaacccggatccggtaaagatcatcaacctgccggaatacgcgggggcgcgtctcgtgccttatctggaagagagaatgaagaccctctgcaggttctaaaaaccaaaagtcttaaaacacaattgaattcattgtatataaaagttataatgcttataaggaaaatcatccagatcaccttattttcatcagggagaggccagaatacacaggatatggatattctccaattccacagaaggaacataaaaatatgagtgaaaaaagcgtaatcgataatatacagaagcactatcgcgaattctcgccgactgaacggaaggtagcggattgtgtattaagacatccaaatcaggtaacagaatatacggtcaaggaactggctatggcaagcggggtaagcgaggcgaccgtcgtgcggatgtgccagcatgcgggatacaccggctactggccgtttcgtaccatgctggcccgcgatatgggaatgatgggaagagaagaaaaaagggataatgaccaggccaatatcgtggccggcatattccggaaatatgcggatatcatgcagaatctcagcagcaagatcgatctggatgccatgagcacatgtgccaggctgattgacaattgtcatgaggtgcatgtgattgcggcgggggatacaggaaccctggcgaagcatatgggattctgtctgggcaggatcgggatcaaggcgacttacagcgggcttgcggattattatctgaataccatcaaccttgccgatgagaatgacgtgctgatcgccatatctaagtcgggcataaccaagacggttattcagggagccgagcttgcgaaggaaaaggggctgaaggtgatcgccattacagaatacagcaactcgaaactgggagaattggcagatcacgtccttctttccaaaggggattcctcccgctttgattattataagaactacaatcacttaagcgagacggcggtgatcgaggcgcttctggaactggtcaagaacgtggacaagattgtggagaaacgggcggaccagctggaatttatgctttcagaggcaaaattatagcaagtttgtgcaagaatgtaaggcgcgggacagaataagcgccgcaataggatagaaagttttcagtgtaggctgtggcagaagataccagttatgttttgccgtagccttattttcgtacggcatattacttatcctgtcactaaaggatattgggtggaatatattattacaactagttctatatggggaggcattatgcagacagtcacccaaaaaacgctggaagacacgatgtattatggggatatccctgtatttatctatcagatccactatccttcctttaccaccacatgtaacgaaaccgccggcagggacataaatgcctactatgccaagagggcaatggatacggaggaatattgccggaatatcctatttgcacaggcggcagaggataaaaggtatcatcaagatggactgctattcaacagttataccctggaggcagtctatcaaattacttataatgccgggtgcattaccagtttatatacggatacctatacctatatgggcggggcgcatggcgagacgaagcggacatccgacacatgggattttatgaccgggaatcggttaaaactggcagacgtctacccgcttacgcctgcttctttgtaccagctgcacagatcgatagcaaggcagattgctcatcggttaagagaaaccccaggctcatattttgatgattataggtctctattaaaggatgcttttaatgtgaaccgtttttatttgcggccgggcagcggggttatctattaccagcagtatgacatagcgccatactccacgggaattccggaattctattttcctctgcgttaacctcatttttgtgcaatatgtagaaaaattaagaacgagccacaaaaactttgaaagtagttgacaacacataaatgaacacatataatgctgtatatacaagtacaacataaaagcaaaagacgaataactgcttttcgataaaataagtaccagtaggacttcatgccatattttctggcatgtatcattttaacttaacttgtatatacagcataatacatgagtggatgaaattacagttaattttagaaccaatacattaaaaccacggaaggaaggggaacatcatggttgtcaattcaagaatcaagcatttgggtctgcctgcagtgagaggcgaagaagcgtatgtagcaaggatagcggaacttccgctgagtctggaagaattcagggcaatttccgggatggccgactatatcggcgtcacgccggaattcaagaaggtaatccagtttttcaaggtgccggaaaaggagaccccggcgggctttgagatccagctggaagtaagcagcgaccgtgtgcttcgtgcgaatctaaagcggaacatttcctatgataagaatggaaagaagcggcccaccaatctgctcttttcggcagacagcgccaatccatacgaggttgctccagttgcggggatgctgtcaaatctgacttgcaatccgggcatcatctacgacctgtttatcaataaccctaaggcaaacgtggggaacaagttcaagaacagagacgaggttatgacggagattggcaggattctgggaccaggatgcgatatcagcgtggaactgaacgacccctttgggaaaagcgatgcgcagattcttgaagaagcagcaaagtttaaggagatgctctcagaataccgggtagtcatcaaggttcctcataccggcccggtaaataaggataacgtaaaagaacttttgaatggagataagaaactgtcccgccggtatgatgatgtgagtacggcggatgcattccgggggcacaatctggcgctgatgcttcacgagaacggataccgggtgaattttactctgatgttcgaaccagcccagacggcgctggcattacaggccaagccgtattttatcaacagtttcatccgccatcgctatatgcagtctcaggccatccggcagtttctggaactttataaggcgactggagacaaaaaattcctggaggatctgagggcctacatggtagaaaaggattatttcgccgcaggcgaggagaagatagatctattcacagtcatggccaaggccaggaccatcatcgaccagcggaatctggaacagaaggaaggcagcgacggcctggatggaatccggcacaatctgcggctgcttaggcagaccaatctggaagatacgcgtctgatcatctgcagtatggagggggattacaattattacgatatcgaccgcctgctggcatcggatgaatatggcgatatggccggacgagtggttcttaccgcagagccgaattatctggcccggttctccagcgccaatcaggtggtctcctatcagaggagattcatgaacgcagcgaatggggagaaataggaggtacatatgaagacaagaagttttgcagaagagttgcagtacgccagagcgcatacgtatgcggtgggcgcgttcaatatattcaattatctgtccgcaagggcggtcatccgagcggcttcgacgctgaactgcccggtgatcctgcagacatcctcagccacggtgcgcaagttcggcccggcagaattagggacgatgcttcgccagctggcctggaatgcgccggtcaatgtgctggtacatctggatcactgccaggatgtagaactggcaaaagcctgtatagactcgggctgggacgcggtcatgtatgacggctccagactgcctcttgaggataatatcgagaattgtaagaaggtcgtagactatgcgcatcacagaggcgtgcatgtggaaggcgagttgggacggatcgcaggcgtggaggatgacttgaaggtgaaggatgacgaggcgacgggcgcgaccttggaagaatccatctattttgtccgggaatccggaatcgacgcatttgcccctgccatcgggacggcccatggagtctataaaggaacgccaaagattaatttcgaactggtcgaccagctgcgccaggcgattgacacgcccatcgtgatccacggaggaacaggattatccgaagagacttttctaaggctgatccaaaaggggggagcgaagatcaacgtgtctacggccctcaagcatggatacatagatggatgccgggaatatatggaagcgaatccgaagaagctggatccgattgattttgaccagtatctgaattgtcgtatcaaggatatcgccatggatcatatgacaatcttcagaaagccaatgcaggtgaggtgataaatgtgaagaaaccaaattatacgattgacttgcactgccacacgaaccgctctgacggtgcggatactccgaaagaactggtggaccaggcagcggaagcgggtatgaaggtcatcgctattacagaccacgatatccggccggttaagacgatcgatgggatggatgcggtggaatatgcggcatcaaaaggagtcgtgcttcttcgcggaatagagatctcatgccagacgacggttgaggattgccacatcgtatgctttggctgcgattggaacgatccgttctttgaagaattggagcgccgggtggtgcagaccaagataaaaagttatcaggaactgattgaaaggctgaatgcggccggatataagatcagctgggaggaagtgctggagaatgacgggaatcccgtagaggaagaacagatacagaagaagatgatcttcgaactgctgagcaggaaagggtatttcccctcctggagcgaggcaaagatcatggtaaagcaggcgccggagttcggcgtgcaaagagagaagcccgacccgctggaggtcatccgggaagcacaccggtgcggcggggtggcgatcatggcgcacccatatctgatcaatgagcctgtaagccttcccgtaagggagatcagcagggaggaatatatccgccgcctgatcgaaggaggcctggatggcatcgaagcatgctattcctacgagaagaccagttatgcgggatcgatggcggcagaggccatcgaactggaagtaagaagccgctatggaaacagcgtgcgcctgatatccggaggctcggactatcacgcggatgccaaaaaaggagcaaagtctccccgtctgctgggcgaatgcggactgacgcatgaagaattcttccggaatccggtattccgggggcttgtggctgacatcgggcgcgtgctgaatctgaagctgattgcagtagaatgccgcaagaatgtccttcgcatgatcagagcgggaggacatggacatgtgggaggcgcgctgtccgccatggatatcgtcaccgccctgtattttgataagatgaatgtttccccggaggaggccgatcatcctgaccgcgaccgtttcttgttatcggcaggccataagtgtctggcacagtacgcagcgctggcggaaaaaggatattttgccaaggaagtcatggatacctatggcgcgcttggctcgaagataccggggcatcccgatatgcataagcttccgggggtggaagccaatacaggagccttaggccacggcctttccatcgccgccggcatggcaatggcagccaagctggagcggcgcagatacaaagtctatgctatctgcggggacggcgagctgccggagggctcgaactgggaagcggccgcagctgcggccaagttcggactggataatctggtggtattcgttgataacaatggattgcagatcagcggccaggtgacagaagtcatgaacatggagccgatcgcaggcaagtttgcggcctttggatgggcggttgccaagatcgacggcaatgacatggaggagattgtaaagatgcttgaccgcttgccaatagagcggggaaagcctacgctgatcctgtgccatacggtgaaggcaaaggggctgtcctttggcgagaaccaggctggctatcatttctggaacgcaacagaagaattgctcagacaggcagaagaagaaatggaggcaagagctgaagaactgagacaggaaatggaggcggtggcatatgacgggtaaattattagatcccagaaaagagtttggcaaggcggtatatgacgtggcatgcgataacccggacgtggtcgtattctccgcggacagcgggaagagttcaggcttcggccaatttatggaagaattcccggaacggtactttgagtgcgggattatggagcaaggcgtcataggcatggcagccggcatgagtacggcagggaaggttcccgtcttctgcgcgatcgctccattcgtcacggcccgcccgtatgaaatggtaagaaatgacctgggatatatgaggcagaatgtaaagattgtgggccgcaacgcaggaatgacctattcggatcttggagccacgcatcaaagcctggatgattttgcgatcatgcggatgattccgggaatgacggttctggcgccacaggatccgatggagatcagacaggccgtgaaggctatgatcgatcatgacggcccggtctatatgcggattggaaaccctcccattccgcagttattcgaggaaaagccctttgtcatcggcaagggggaggtcttgtgcgaaggaagcgacgtcacgctcgtatccactggatcaacgaccagggatgcccttgacgcggcggaacttttaaggaaaaacggcataagcgttaaactgatcggcatgcccaccgtatgccctttggatgaggaacttctgatacaggcggcagacgagactggaaagattgtcacggtggaagagcattatgctgacggcgggctgggttctctggttacagaggcgctgagcgagcggaaggatgtgagggtccgccggcttggaatgccaaaagcatatgcgattaccagcggcaactaccgccagctggtgggacactaccatctggacgggatcgggattgcggcttctgtggaagacttcctgaatcaataagaacatctgaaggtaagacatttaccttttgaatgtagagaaacactattaatcacggcaaagtttaaggaggaaaataactatgaaaatccgtggaattgaaatcaacaaagcgtcccttgcaaaaatgatcgatggttctttattgaatccattcacgacccttgatgagattaaggaattagtagacatgtctttggaatatcatacgaattctgtctgcgtcaatccgaattatctgaaatatgttgcggacagattaaaaggaacggacgtcaaggcatgcgtggtaatcgactatccattcggaaccggaacgatcgaggacaaatgccgggaggcagagatcgcgatccagaacggcgtggagatcatcgattatgttattgattatggacacctcaagagcggcgacaaggcccatcttctggaagaggtcaaggcatgcgtgaaagcggcgaagggcagggagacccgttttatcatcgaggtctgctatctgacagagcaggagatcgtagatgcatgcgaatgcgtgatcgaaggcggcggagactttgtaaagacttctaccggacgcttcggaggcccggatatgaagatcatcgacctgctggtaaagacctgcgcaggacgctgcaagcttaagattgcaggaaccggacagttctggactaccaacatcgccctgatggctgtagcagcgggcgtagacattatcggcactcgttctgccaagaagatcgtggacgaacttccaatctttgaatccatggtcaagaacattgaagtataacgtttaaaaggccggattttccggccacacaaaagataaaggagaaaaatatggggaaatatgtgataggaattgacgcgggcacgatgggtgtacgctgcgtaatattcgaccttgaaggcaatgagatttcttcggcttattttgagactcctacagtatatcccaagccaggctgggtagaacaagacgcgaatgatgttattgaactggcatacaaatcggttgcaaaggcaattgaaaagaagaatgtggacacttccgagatcatctcggtaagcttcacgaatcagcggacttcctgggcaccaatagacaaggatgggaacttcctgcacaacatgatcctgtggcaggatcagcgcggcgcggagatctttccctgggccagggagcagcttgcaaagcatggcatgacggaactggatctgtacaaacgctgcggacatccgctgggatccgttcaatgtggatctaaggcattctggtaccgtctgaataagccggaactttatgggaagacatacaagatgattacgccgcacgcgatgcttgccaaggcattcggcgcggatgactggtatgacgaggaaagcgatgccaactggtggctggtgacgaacggggatacctttgagtttgacccggaactgtgcgacatctttggcatggacattgacaaatatccaaggaacatgaagccaggaactccgatcggtgctgtgacggaggaagtttccagaaaatgcgggctgaaggtaggaacaccgctgttcgtaggatccggggaccagcagtgcggcgctgcgggagtgggcaactctggagaagccggtcttggctctgtgtgtctgggaaccgcgggattgtgtatcggctactcagctacgccggtgcgtgacgccaacggcaagtgccatgtgcttggccatccggcaggcggctacacgatggaaggccatgcctcggcggcagcctcttccttccggtggtgcaggaatactttcagccggtttgagatgacggcggcagatctggcggatatggatgtctacacgatcatgagttccattgcggcaaaagcgccgattgggtcgaagggaaccatcttcctgccatggcttgcaggggcggcgtgcccttactacaatgattccgcgcgaggcgcgtttatcggcatgacccttggcgttaccaagtcagaacttctgcgggccgcgatggaaggcatctgcttcgagatgcgtggaatgctggatgctctcaaagatgcaggatttcatgagtttaagaagcttcgcgttacaggaggggctgcccgttccgatctgtggaaccagatccaggcagatatctacggatgcccggtagaaacggtcaatgcatcggaagccaccgcacttggcgcggcgatgatcggcgcggttggcgcaggcgtatttaaagatctggccgaagcgtcccggcatatggtacgtgtcaaggatacttatgagccgatcccagaaaacgttgagcgatacaacgaggtctacgaggtattcaaggcctgctacaagggcctggcagcggacggatttgaacagatcaatgcttaccagaacaagttctgttaagcggcacagcacaaaaaggagatatgtcatggaattttcatttttaacagcacgaaaaatcgtatttaagacgggtgcggttgcagacattgcccagtacatagcaggatatgggaagaatttcctgattgtggtggatcctttctttaaagagtctgaaacaatgcagaaggttaagagccagctggactctatcggcgcgaagtatacggtctacggggaagtaagcggagaaccgacggtagagcagacggacgaagtctgcgaacttgccgtaaagaatggctgcgatgcggttatgtccatcggcggcggcagcaatattgacgtaggcaaggcagtcgcagcgctgattaccaatggaactcccgcgatcgactatatggagtatgtaggccgcggcaagaaggtagaaaacgagccggttcccttcatctccattccgacaacggcaggaaccggaagcgaggttaccaagaattctgtcctgggatcaaaggtccagacattcaagcgctccatgcgctcggatatgatgctggcgaatctgactatcgtggatccggaattaagcagaggctgcccaaagaaggtgacggcatcctcaggcattgacgccatgacccatctgatagaggcttatactacctggagggcgactcctatcagtgacgggctggcgctaaggggcatcgagctggcgggcagatatctaaggcgcgcgtatgatgacggaaacgatatggaagcaagggaaggaatggcggcagcggccctgctgggcggcatggcattcgccaactccggcctgggggcagctcacggcataggcatggccgtcgggattgcttaccatgtgcctcatggagaagcatgcggcatcctgcttccacatgtaatgaagctgaatcagaagaaggcggaagaaagaatggctaagattggagaagcccttacaggaagacggttcgcgaagccggaagaaggcgcgcaggcagcggttgattttattctggaactgaacgcgcatatggagatcaagccggacttcaagcacctgggaattcctcgcgaggatatcgaaaaactggcgaaggccagttacggaaccagcatgagcagtaacccggtacagcttgagatggatgagatgatagaatacatcagcgagattgtatagaaggcaggtcatagatgataagattagttgccagtgatatggacggcacgcttttgaattcccagaaggagaccgggcgcggactaaaaggcgttatccgtacgctgaggaaccgaggagtgctgtttgcagccgcaagcggcagaagcaagagcagcatcctgagttattttgacgatatgccggtgacggtaatcgcaaataatggcggcgcggtctatctggaggatggaaccctcctttttacaggagagttcccctacgaaaaggcaagacccgtcatggaggctgcccggtcagcctcttacatgcatctggtcctgatcggcgtaaaagacacttatgtccagatggatgagccagaggaacataagatattcgcggatttttatttcaataagaaggtcaggttcgtccccagcctggagcaggtatttttgacggatcaaatcgtaaagatatcgattagcactggagcgaaccgtcaaaatgagaaccggggaatgaagtttatgcagcagtttgcggattcgttttccctcgtactttccggcgatggctgggtggatctgaccaggaaagggatatcgaagggatatgggctggaacaggtgtgcaggcactacgaaatagccatggaggaaacgatcgtattcggtgattatctgaatgatctggacatgctccggcttacgccgaacagttatgccatggccaatgcacatccggaagtaaagaaggcctgtatgaacgtaacccgttttaccaacaatgaggacggcgttgtcagagaactgacgaatatattcggattagagtagcagtcagcggatcggcaatgggatcgaggaggaaacataatatgatgacggttagagaatttgcaaaacattttgatttggcatggcttgcccctgacgcacaggaaaaagatatcattgccgcctgcgcgacagctgctaaataccaggtaaactccgtgaatgtcaattcctgctgggcagaactggcgaagaaggaactggcaggaacaggcgtggggccaagcgctgtaatcgggttcccctatggcgcatgcatctccgaatgcaagtttctggaattggagcggatggtggaacttggatgtacggcgtgcgacatggtggtgaacatcggagccatgaaagatcacaattataagctggtagaagaagagataagaaaatttgtggagatatgcaagcctgccggatgtgacacgaaactgatctttgaagtgggatttcttacggatgagatgatcgcggatctgacgaagatctgctgcggggcgggggttacatatgttaagacggctaccggaagccaggcatttccggatatccatcaggttaagatcatgaaggaaaatctttccggcgacacgaagattaaagtatccggcgttccaaggacattcacccttccggcagccatgtatgcattcgagcatctgggcgtcagcctgatcgggacaagaagcgcgggcaaactcgttgcccaatatgcagagtacctggaagagataaaataaaagggtctttgctggctggattaaaagagggataaatacaaaggaggaaaaaagatgactacgtattttgtttctattgacattggaactactggcacgaaggcgatcgtctttgataaaaaaggaaatatcaaaggcagcgggtcatttgatacgcctacctatttcccacgtcccggatatgcggaacaggagacgcaagagatagtagaactgctatacagcgcgacgaaatatgccatcaataatgcagaaatcgatccaaaggacatcgaaggaatttcattctcccacatgtgctgctccttcgttcctgtggaccgggaaggaaactacctaagccgttctattctatggaatgacttccgtggggaagagatgttcccttatatgagggagcgtctggaggcaaatggcatcagcgagctggaagattataactttacaggctatccattcggaccgctggcaacaacgccgaagttcctgtggattaagaagaattggccggaaatctatgaaaggacttataagtttatcgggctggaggctgtaatgatcagcgcgttcaccgataacatcgaggaatactgggatgataagccaggccttacctacaccaagctttcgaataatgacacgtttgaattagatccgaagcgcgcagagatctatgatattgacattaataaatatcctggccgcaagaatccgggagaattcgtggggagcgtgaccgaacgggtagccaaactgacaggcctgctggccgggacgccggtgtactgcggtgccggggaccagcgctgcgcggcagtcggcgcaggcgtcgcaaaagacggcatgatctcgggcgtgcttgggactgcgggagtaatccatgcatacagttcgaagccagtcaggcacccggaaggcaagatatccattatgggacatgcaggaacgggacactggcaggtggaaggctcttccaactcaggagcatcatcgcttcgctggtaccgggatgtattctgccagaatgaggtaggcttctccaagttatccggcaaggacatctatagcatcatcagcgatctggcggccaagtcgccggtaggctcgaatggcgtgatctatgccccatggctggaaggatgcgactgtccaaggtttgacggcaatggccgggccacctttacaggactatctttttcccataataagaatgatattgcgcggtccgtgctggaaggcgtctgctatgagatgaagagcatgatcgatgatgcggaccggacgcttggatttaagacgaagacgcttcggactgtgggcggcggcgcaaagtcgcgtctgtggaaccagattcaggcggatgtctacaacaaacggatcgagacgcttaaatgtccggaatcgactgcgcttggagcagcaatgttcgcggcgatcggctctggcacttactcggatatccacgaagcaatcgacaatatggtacaagtcgactattgcctcgagcctatcccggaaaatgtaaaacgatatgaagaactttacaagatatacacggaactgtatgaggacttggctgtgcgtgtatttcctgcaatcaagaaatatcaggacaggtgttttgaaggataggaaggagaattcttatggagtttacattttatactgcggataaaattgtatttaagcggggcgcgcttaaagaagcaggggattacatcgccaggctgggcaagaagttcctggtcattatagacccattctttgcggagagtccggcaatggaagacttgacgagacagctggaagcgctgggagcagactatctgatctttagcgaggtcaggggagagcccaccgtcgatctggtggatgaagtcagcagactggcgcttacgagccaatgtgacgccgtgatctccctgggaggcggaagctgcattgatgtaggaaaggctacggcagccatcatcaccaatggcggcccggcagtggattacctggaagtggtaggaaaggggaaaaaggtcacggaggccccggtacccttcgtagcgatcccaaccacagcgggaacaggcagcgaagtgaccaagaatgcggtgcttggctccaagacgcagggattcaagcgttctatgcgtgatgacaagatggtggctaccattgctatcatagacccggaactggatatgggatgtccacggaaggttacggccacatccgggatagatgccctgacgcatctgatcgaggcctatattacattccgcgcgactccgatcagtgatggactggcgcttaaaggcatcgaactggctgggaaatatctgcagagagcctgcgacgacgggaaagacatggaagcgcgggaaggcatgtgcgccgcggccctgctgggtggcatggcatttgcgaactcgggacttggcgcggctcatggatttggcatggcagtaggcatacgctaccatctgcctcatggcgaggcctgcgggatcgccctgcctcatgtggtacgcctgaatgcaaaagcatgtccaaagaagatggataagatcggcgaggccctgacgggcagacgatttgacaaggcaggagagggtacgcaggcagcgatagatttcctgtttgacctgaataaggcaatcggcattgcgccggattataaattcctgaacgtacctcctgaggaagtggcagaggtggcattgggcagcagagggacgagcatgacaagtaatccagttcagttgacagacgaagagttgatcgcatttctccggaacattatgtagcagttatgattaccgtttgtacaaaagagaagatttggaggagaaaattatgttattgaaattcctatctgagttagttggtacatttattctgatattgttaggagacggcgttgttgcaaacgttacgctgaacaagtcaggcatgaaaggcggcggcacggtgcagatcacgcttgcctgggggcttgcggtcatggttccggcgtttatattcggcgcggcgtccggcgcccactttaatccggcccttaccctggcgcttgcagtggaagggagtgttgcgtgggcagaagtaccgttttatatcatcgggcagtttgcgggagcgtttctgggcgcctgctgcgtataccttctgttcaaaggacagtttgatgccacggaagatccaaacacgaaacgaggcgtattctgtacatcgccttccattccgaacaaagcccttaacatgctctcagagattgtggctacattcgtgctggtatttgccattaaggggatcggacaggtgtccggcattgcgggcggcttaagcaatgtattcgtctttggtatcatcacttccatcggcatgagccttggaggcctgacaggatatgccatcaatccggcccgtgactggggcccgcgtattgcccatgctttgctgccgatcaaaggaaaaggcccgtctggctgggactatgcggttgttccaatggtgggaccgattatcggagcgttgcttgcggttgggctttatgcggtaattccgtggtaagaaacaggatacatcaaggttaagaagaggggtggcaaagatgaagattgcgattggatgcgatccaaatgcacaggaagcaaaagaagaattaataagatttatcaaagaaaagaactatggcgaggtgacggattttggaagcactgaccctatctacgcgaatacggcgatcaaggtcgcggaggcagtagcatcgaagaaatatgacaggggaatcttgatctgtggcacaggcataggcatgtcaatcgcggcaaataaggtaaaaggcgtatacgcggcgcttctatcggacgtatattctgcgcagcgggcccgcctcagcaacgatgccaatgtagcatgcatgggtgcatttacatcaggaagcaagaacagggagatgatgacggaagcgtttctttccaatgaattcgtgccaggatgctcatcccagccgaaggttgaggcgtttgtcaggtatgatagcaagagataagaggcagtctgatcatgaaaaagaccggtgcggaaatatctgtatccattcaggtgtttccgcatttttaaattctttctcccttaattcgcttgcatgcttttaatttagcggatataatgaaagcaaagtctgaggttgaaatggaggtagcaaattgacaggcctaaatttagatagcccctgtccgttatatgttcaactggagaaaatcttgcgtaagaatattgaaaaaggcatttggaaagaagacgcaagaattccatctgaaaatgaattaagcagagaatatggtttaagcaggatgactgtaaggtcagttttaaataaattggcccaggagggcttaatttaccgggttccgggtaagggtacttttgttagttcgaataaaattataagcaagcccctttctcagatgggaataagagaccagcttgagaagatggggtatgaaaatgaaaccaaattgatttatacggatactgtagaatgcgatatcaaactggcaaggaagctgaaagttaatattggcactccgctttataagattaagagggtaagaagcgtgaatgacgagccattcagcatacatctgtcctatatcccaaagcagtgctgcgaagggatctttgagcggggatatgactttgagcatatgcagctgtgcgatatcttgaaggaaggatatggcatcgagcagaaccagatggttgagacgctggagattgtcaatgcaaggccggatgaggcacaactgctgaatgtagatgagaattatcctttgatccaccttgaaaacactttgtactcccagatgggagaagtgacggaatattcttccgttcttttccggggagacagggtgaagattgagataaagaatacgtatagttcataagaatgacaggggccttgtgcctctggtgcggccgacatccttggatgccggcctttttcctatcttttaatgtgattcttccaaagtccttaccggcttgccatctgcgccttcgtatgctctgccccagccggttattacggagaacagcagtaccaggaacaacgagaagcagtaaaacatgaatccgcttacctgagtaacggataaggcatctgcatactcatatccggctgtaagggaagatccgatgaatacgaatacgctcagaaacggaactgccaggacaatggaattggcaaatccatccagcagattggcccggcggtatggatgcaggccgacgcgcttcccaatctcgttctggatctttccaaaggtggccatggaggcgctggtcacgccgccgaagaacatggttgtgatggagattccaagcatcatggcaatctctgcgccgcgggtagtctggccaaacttgctgcccaggatcatattggtgatcttctctaaagctccggcagcagtgagtacgcccatgattccatatacggaaagtacaagggtgatggttgcgatcatcccattgatgccatcggtgaggaagccggcaggcgcgccgtccttgacggaaaggatgctgcttggggtcagaaggtggaatgccagtcctacgatggttcccagaatcagtccgacggtaatggctttataaatatttctggtttttacggcggtaaccagcatcaccactacaggaaccagcatgaccagcgtggcagggttcatattttgggagagtatctcctctgcgccgctgccaagcgttccgccgcctccaaagatccagaacagtacaaaagagactgcgccggcagccagcgagtatttcaatcggctggtcacgcatccgcctacgtcagcgaagccggattttttcgtgtattcctgggtgcccgcagatataatcgtcgtatcggagataggagccaggttatcgccaaagattccgccggatacgatggcgcccgccagcgcggccggattgcttcccagcaggatgcctgctgcgtagaagatagggaaacaggtgaacatggttcccagggaggagccggttgcggatgcaatgatacatacggcaaaaaaggtaaatgccgtaaataagccgccgcccacatgcagtttatcggcgagccatacaaagccggtggaaatattggcagccttgatcatggcagaaaacatgccgatgatcagcagcaggacggcaaccgggatggcctctttcgcgccatcatagacggcttcccagaagcggtcataatgccctttcttagtgaagacagcgctgatcagcagtgccacgaaggctcccattgcaagcgcgtacatttcaaatgctttcaatacgataaaatataagatgcagaagaataggaagatgcatactggaaggaatgcaaccatccatcctcctctgaattcgagttttttcttttccatatcaggtgtttctcctttgtagtgttaactttgttcctctttcgtgatattcatatgcataatattacggtattttgaacctacggtacgctctaactcaaacggctcgccctgtggagtcggaaattgcttaaggaacgtgcggattgtgtgaatatcgttttcagacagttcaaacttgaatatctgcgcattggattctacgtgcctgctgttgcggactccgacgatagcgccggcaacgccgtcctggcttaggatgtacttggttgcgacattggaaatgctggcgtcatatttttccgcaattccttttagaagtacaagcaattcctggtaaccatcccagcccagagaatcttcgatgatctgaaggtattttacctgggagcgggtctcgggctccgcggctttcctgcccatccatttctctgccaggaatccgccggagagggttccgtagcataatagcttgatatcattttctttgcagtagtccagcatcttccgctccgtacggcggtcaaatacggaatactgcgcctgcatggagactaccggaattccggcatccaccagttcttttaaatgtgccgtatcaaagttggtcacgccgatgttgcggattttccccttttcttttaagcgcatcaggtcgcctgccgtctcgatgcatcccggaacatcatagtcccaccagtggaactgcaccagatccagggtgtcccggttcaggcgcatcaggctccggtcgatgatcttttccgtaaattcatagtttacctggcttaagtaattaatatctggcacatatttcgtatgtatctggatatcgtcagcggaaaagccgtggccgttctttagttccgttacgaactggccgatgaattcttccgcgcctgtgtagatatccgcacagtcaaacgttgtaaatccttgctctaccagcatgtggaacgctttcataacatccttaagatccaggctgccctgcaggctgtggcctttcgagagctgccagcagccatttaacaccctgctgatcgtataatccttggctaattccattctctgtgtcattttctttccctccatatcaaacttaattaatcttcatttccctgataaatatcttccacagtacaatcggcgtggctgaatgtccgcttaccgatcctcgtaatcttaaaccgcgcgccgcaattgggatctgggcaggcaatcacgctgtccgagagcatccagtcattttcatgcagttctctttgcttagccggaagaagcggaagcaaggcagcaagggaatacatggaaaatgaggtggtctgcggaaagaccagattttctccgatgaccaggaagtagtccccctccttatggctgcataccatgggcttgtctgaggcaataacctcgacctttagatcgtacaatgtaaattcatcatgattcatagataaacatcctttccagtgaaataaaaaaacctgtccttgaatagattcattcaaggacaggcataaaacctgcggtaccaccttgtttggtataaaatataccctctttcacagagtgccgtcacactcctgaccctataacgctggtcttgcgtctcagttacttgataaacgttcacttcgccctccgaggcccacttgctgctactgacatctgtccggcttccaccatcccggattcgctgaagaccgttgcacagcctaacttcctcatctgcggttttaatttttaacattatagcaccgcccagcagaaaatgtcaacaatcaaagcagaagaagatagtgaaaatgagccttgtatatgctatcatggatttagtcgggaaacggctatctctatcagacgatcagattgacaagaagccgcctcattaccagaaatactgggaggtcgcgatcgggggctggaagatgccgtggaacaagcagatcaagacggacagaaaagcacaaaagagaaataagaagttgtcctgggccgagcaggagcataccattcatgaggtaggctcaacctatacgatacagggatttgacctaaattatgtaggcgtgatactggggccttctgtaaaatacagggatggaaagattgtctttgatccgtcctgcagcaagaataaaaaggcagtacagaacaggacgttaagtgatggaaccaagcagaacttcgcgcagacgctgcttagaaatgagatcaacgtacttttaacccgaggcgtaaatggactctatatttatgcccaggatgaggaacttcgggaggcgttaaagcatgcaaagcgtcactgacagagaatgagaaagcgggggatatggagatgtcagaattgcaggaactacaacatctggtagaacgattttgtacagacagggattgggaccagttccacaatcccaaagatctggccgtcggaatatctaccgaggcaaatgaattgctggatatattccggttcaagtcggatgagcagatgaaggcaatgatgtcggatgacaaaaagagagaacatatcggggaagaactgggagatattttcttctttttgctgcgcttcgcccagagaaatgggtttgatctaaaggattgcctggaagataagatcaggaaaaataatgagaaatatccggtggaatctgtaaaaggtagcaatctgaagtatacggagagagttggagatacggatgaaagagataaacttcaattactatgaggagaacgcctcagaattctttgagtctacggtgacagcggacatggtagatctatatacctcattcttatccatggtcagtccaggaggaaggatattggatctggggtgcggcagtggacgggacagcaaatacttcataagacaaggattccaggtagaggcaatggatggttctccggccttgtgccgtctggcttctgagtttattgggcaggaagtattctgcgcccagatcgaagaaatggattatcagcaggagttcgatggaatctgggcttgcgcttctctgatccatgcagagaagaaagagatgcagggcgtgctggagaaggtcaaacaggccctgaaaaaaagaggagtcctgtatgcatcctttaagcagggacaaggagaagggatgagaggcggccggttcttcaacttttatgatgagaaggaattgcgattattatttagcaggatcgatggactggaactggtgcagatcttcaggacggaggatgtaaggcgggataagagcggggagttctggatgaatgtaatagcaaaaagattatattaggaacgtgtatacgtgacagccaagcgcacaggatatcatgcatcgcgcttctgctttggctatacttggcttatggaaaggaggagaacgatggagtggatgaaagggctgcaaaaagcgatagactatattgaagaacacctggatgaggagattgactatacggagattgccaggcaggcatattcctctaattttcattttcagagggtatttcatattatctgcggatattccgtaggggaatatatccgcaaccggaggctgtctgaggccgggaatgacttggcctgcggggactgcaaggtaattgatgccgcattaaagtatggctatcaaagtccggaaagcttcagccgcgcatttacgaagtttcacggaattacgccgctacaggctaagaccggaaaaggaaatctcaaatcgttttccaaggttttcctaaaactagtattagaaggaggaacaacgatggattacaggattgagaaacaggaagcattcaaggttatcgcaaagagggcaagatatgaagggggaggggagatttcccagcaaaatatccatgctacatgggaaaattgccagaaagacggaaccatcgggaagttatgcaagtatgtgaataccgagagtattttcgggaactcgattgtaggaatctgctttgacaatccaaatgaaggagattttgactatgctataggaacagcgtactcaggcggagccgtggaagaagggctgacggtggaagaggtgccagctaatacttgggtggtgttcccgtgtacaggggctatgccagaagtattccagaagttgtggaagagagtttatacggaattctttccaaccagcaaataccagccatcaggcggcatgtgcatagaagtatatccaagtaatgatgtatattgcaatgattttgattgcgagatatggttgtcggttgtggaaaaataattaaaaagcgcctattgacgagaatatcattctatgctattgtaaacatacagtgtgtatgtaaaagaggtgaggatatgccgagaaataaatatcctgaagaaacggtagaaaagatattggatgtctcgttgaaactgtttttggaaaaaggctatgagaatacaaccgtccttgatattgtggatcatctgggaggattgacaagaggggcgttctatcatcatttcaaatcgaaggaagaagtgatgagcgtgctgtcggagcggctgttctatgaaaataatccctttgaaaaggtgaagcggaatcaggatttgaatggtctgcagaaactgaaaaagatcattgaagactctatggaagataccgcttaccggaagataagcatagaaagtattcccctgctggataatcccaagtttctcgcggagcagattgaaagcaaccgggacatagtcatgcctgcattccaggaattgattgaagaagggattcaggatggctctattcatacagattatccgaagcagacggcggagattttgacattcctggttaacttctggatgataccaagcgtatttccttatgaagaagaggaaggaattctgcggattaagctgctgcggcaggttacggacagcatgggaataccgattattgacgatgagttgatggagcagatggaaaaggtgctgagtgattcaaaataaagttgcctgaaagggcaattttattttacacatatacatacatgctgaatgtatataaaggagagaatgaatgaaaaaagaaaaattatttaccagaaactttattttcctgatcctgggacagattaattccttatttgccaatacgatattgaggtttgtactgtctatgtacatcttggagttaactggctccgcatcaattttcgccggtcttttggcggtatctatgatccctacgattctgctatcgccctttggcggaatactggcagacagggcaaataggaggaatatcatggtgggcctggactttctgtcgtgtattacggcttttgtaacggtacttttgatcaacgagtccaacgctgtcgtaatggctggctgtgttctaacggtcttgtctattctgggagcgtttgaatcgccgaccgtccaggccgtggtgcctcagatgcaggaaggagacaatattatacgggcaaatgcggctgtcaaccaggtggctgcgcttgcggggctgatcgcgccatttcttggcagcgctctttatacgatctttggtctcaggcctgtgctggctgtcagcgtaggattctttttccttacggcagtattagaagtatttatccgactgccctaccatcgggaggaaacaaaccaaaagtggacggcagtaataaaggaagacttccaagtgagtatccgctttatcacgaaagataagcccgaaatattacggatgcttctggccgtatccgtagtcggtttctttataatggggacgatcaatgtagggcttccctatatcgtcaggacagtcctgggcctgggagcggaacatgtaggaatcgcggaaagcgtatgcggcgcaatggcaatactggggagcattattgtaggagttggagtaaagcatatgaaagcggcacagatgtacaaatacctgtttgccgtgggagccttcatgattcccatggggctggcattcctggctgacaatgtacgattgatctatctgattgttctggcatcggttgccggagtccagattctggtaagtatcttttcaatctatagcctgtcgctgatccagcagcagacgccaaatgaactgctgggaaaggttatggcttatattgcgacgataacattatgcgcgcagccgctgggacagatgatgtatggaatcctgtttgacgcattttccagcaatatcatatggatcatggttgggtcggcagcgtgtattatgctgatcagccttatggcccgaaacgcatttttatactatgggtataatgacaaatgacaggaggcgtgttatagtaaggatatcatcgaaagatagaagagtggaggcttggaaacacaggcaatccgggaaaggaaaagacaatggcgaacattacaattttagcggatcttcaacttaacagtgaacgcatggatgctctggaggaaagacagagtctctttgtagtgcattccggtaagatgacagagtccaggaagactgtaagtttgccatgatggcatatcgcattctggtaccgcttatcttatacggataggcggtattttttatgccataggagattgattttcctataggaaggattcttttcatttggggaaatatagcatgggaaaatgtaggaggtgttgaaaatgtttgagatcaaagggaaggtaaatacagccatttgctatgcaaaggtggttgaggatgaagagatagagcagattcgccgcatgtgcgattatgaatttgcaaaaggaagccagatacggattatgccggatgttcatgcaggaaagggatgtaccatagggacgaccatgacgatagttgataaggcggttccgaatgtggtaggagtggatattggctgcggaatgtatacggtgaaattaagggataatgagatcgatatgaagaagcttgacgcagcggctcatgatattccttcgggcatgaacgtgtgggaagggagaagggcgcattttgacctggagaggctccggtgttaccggaatctcagggataccaaaaggctgcagcgaagcctgggtaccttgggaggcggaaatcactttatagaagtggatcaggcagcggatggaaccaagtatcttgtcatccacaccggcagccggaatcttggaaagcaggtggcagaattttaccagcagctggcagtagacctccacaagggaaaagaggaatattttcaaaagaaagacgccttaattgcagaatacaaggtagcgggaagaagaaaagagatccaggcggcattgaaagaacttcactgggctaaccacgaattgttgataccggaagatctttgctatctgtatggaagatatttcgaagactatctggaagatgtccgcatctgccaggagtttgcccggaataaccgggaactgatcgcggaaattcttctggaaaaaacaggcctgcaggcaaaagagacgttccacaccgtgcacaactatattgacgtggaggaaatgattctaagaaaaggcgctattgcggcgcataagggggagaaggtgctgatccccattaatatgcgtgatggcagcgtactcgctgtgggaaaaggcaacccgcagtggaactattccgcaccccatggggcgggacgggtcatgtccaggcggacggcaaaggaaaaattgtgtatggcgcagtatcaggagatgatgaaaggaatctatacgacgtctgtaaacgagtcgactttggatgaggcacccatggcatacaaatctttgggagacatcatagacgtgattcaggaatccgtggatgtgatagaaatattaaaaccaatctataattttaaggcttctgactagagcacggctaaagcagtgactgttctggctggaagccggaacaggaggaaaataaaatgataacgatgcctgtcatagacatggcaaaaacaggacagaacattaggaacttaaggatatcgaaaggcctgacggtaaaagacttgcagcagctcttcggcttcgagacgccacaggcaatctacaagtggcagtacgggaaggccttgccgtcaattgataatttggtggcgctggcagcggtgctgcaggtttcgattgacgatatcctgattgtgcaaaatgagatgtatgactgcaaaggggcgtgaaggcgctcctctgctctagaattgattgagtgaaagccgggcagcaggcccggcggatgaggccccatagtcaagtggcttaagacactgccctttcacggcaggagcggcgggttcgaatccccctggggtcgtttgttaaatggcattggatttgagcggtaagaagatgtatgattaagttaagaattatttcgtatcttgaaaatcgttattaatataaaaagaaaggcttggctgaaggaagtgaaaaatgtcaaagagataaggaaagggtttgaaaatgccatagattttctaatgttcagttattttggaatatcgttagaggatggcgaagatagagagcagattcttgatgccgcggtaaagagggcgtatattgatgcaacgcagcagggttcttacaatgctatgttgaaagggaagaataaggatgcttcaaaagaaataaaggataaggcaatacaaagattgaaagaagcagtagatgaattgctaagcaataaagttctggcagaatcatatagcgcatggcatcaaaagatgtgtaaagagatatgcatgctttatgaaggagtcatatttataaacaaaaaagagaatgaagagaaggcattttcatatggaaatgcacagaaatgggtcaatatgacaatgaagtatatatatatcttgcatgctgtatataaagagaaagccgctaagtgtgatttttgcaatacatatggagaccagatagatattttgatgtgtgatcttgatgttccggttgatagttatattctaaaaagcgcctctaaaaaatataaagattgtgaaaaggcttatgggtttgacatggaaattcccaatagagaaatgattgtaagaaatggaaaagaagtagaactgcctgccaaggggccatattctgatgagaagaccaagccgtggagtaaatggtcgaaagaagaatatgatgatttccaaaaagaattaaaaaagaggataaaagataaatttccaggaacgtttccgatagagtgggaaggatcagcctggatcgaaatagcgaaaaagcggaaataattgtgggcttgggactggtttgaagaaattggaaatatggttcaggtgcgaatggtaagtgcacataaaatgcgtgggggattcgcacctggaaaaaggggttaatttggagaaaaggttagaaaaaattaattttaaagaaggatttgcttgagttattgtgggttttgtgtgtaatatgtaagtgggcaagaggtatttttgtgcgtttttgctgtctccctctgcgaggagggagtggattgaaatggctgccggcatgcaggccatgcagggcctgacagtctccctctgcgaggagggagtggattgaaatatccagtgttatttcgcctctgccacaaataccgtctccctctgcgaggagggagtggattgaaattgcgctcatgcacatcggctcgcctgtctcagcatgtctccctctgcgaggagggagtggattgaaatctgcactcaatcccatttgctggagacgagctgcagtctccctctgcgaggagggagtggattgaaatggatattgctgataagtagacttacaagcatgaacgtctccctctgcgaggagggagtggattgaaatcatcattcgtgatttgaaaatgcgccagcgccattgtctccctctgcgaggagggagtggattgaaatttatccaagcgtagacgatatatgcctgatcctgtctctctctgcgaggagggagtggattgaaatgtgtcattaagataggcaaagtttatagaatccgtctccctctgcgaggagggagtggattgaaatttggatatgatctattaggtcctgatagtttttcgtctccctctgcgaggagggagtggattgaaattttttggctgttacggaatgaggatcgggatagcttccctctcgaggtaaagtggattgaaattcctggtaactggtgccatatgaaaaagatgttaatgaacttcgcggccaatacatgatatatcctaaaatacataaaatcctttgtgaaaaaggttatgctgtaagcattgcttcccttaagattattatgcaaaaggaaagagcacggatgtatgagcataggaagaaagcaaggaacagtctaaatttattcagagaaaatctttatgtcaattaatttataaaaaatatagaagatgttataacgatacctcaaaacaatatgaagaagtattgaaagaatatcctcaactaggacaaatatattctttggttaaagatttttacagtgtgattttttccaaaaagccagaaatattagatgactggatagagtttgctcaaaaatgtgatatacctgaattacagacatttcttgaaggatcctttcgagatataagagcaatcaaaagcagtattacttattcctacaataatggtctgacagaaggtagtgtgaataaaattaaagttataaaaagaatcatgtatggttgatacagtattgatttattaaagcgaaagtattgtttcatgaaatttttcacagtgaatttaactaagttcggaaagaaccagataactgtatacggatatttgcagtttttattgtgaaagaccagtcggagtttataaatggattttttgaaggaaaaaatcagtggtataaaaaataatcgtggaaaaaaggatgacggattacgttttgtgagaaagattggaagtatatgatgctcaattggattaggtatataaaaattctgcaggttatgttcatctatctgataagatgttttattctagtgtgactacttcgtccttggagcaatatgatattgaggtttcagttagatagcctttaaaagaaaaggcaaatccggcattacttcaagtagcgaaaatatttattcattatgttcagttacaaaataatattattaatcaagtgattatttcaagaattagtgaatagtaaacacccctgtttctactatgcttttctacgattgttgtcctcaacctgccccgatttgcctcgttttgcccattttacgataaatttaacaatctatagggcgcgatataatggtcggcaaagcggagcataatacagtattttagagtgttaattaatgttcatttctattgtcataaagaacaaaaaagaggttaattatggaatatttatctatcaggcaaacggcagaaaaatggggaattttgggaggacgcatacaaagattatgcgcggaagaaagaactccaggagggacaaaactaggtagttattgggcggttccgactgatgcagagaagccaaaggatgaacgtgtgaaaagtggaaaatacatgaagttgaatcgtgctaaattctaaatgagaatgattagagtaatgaagactttggctttaatgatttagccattggatgggggaaaagttatgtctatacggttatggcctaaagattttgcaaaaaaagagcatatatcacaaggagaaaaagcattattaagaaacgcatcaagaaattttaaagaggggcattttgcggttaatattgatcctgttcgtatgagtacaagtgctgtgaaaatggggttgtatctttcgccaagtgacggtcttgtgactttttctttatataatggagagatagattcaaatatggttaataactatatcctgtatgtaaaaatggtggaggataagatatatgagcgtttaatagattcaaaagtgttaattgtgcgtaccggtgaatataaagtgttgagatttccatataagcatatgattttattccctgatgtttctgtagatagaatacagatggcagatgaacaaaaagcacagttagctgagtatgcgtccttcatgttttttcatccaatcgattctaccgggaaagaaaagcatcttaaagacttgaggattttcgaatatattcgaaaagagtataatccgaattttaaaagtatttctgaaatagagcagaaggcaatcttcgaaagattggcaccggagtacactgtcgtaatgaatgaggttgagcaagtgaaagtgccggttgttaatacgatccatactgaagaagaaatgctaattactggagatgagttggagtataagacttttttcttggatgaatatcaggtgggaattgtaaatgatatgggacgaggtcatcgagtggtgcttgcaaatccaggtgcaggaaaaagtgtattacttctctcaaaagcatttaagtatgcaggtatgtataaagaatcgaacattcttttgacttgctataacagtaatttagcggattcgtattgcttcaaaagaagttgtgcaaatttcggggaaggcagtaatctgcatatcatgacatttcacaaattggttaagaagatttatgaagagtgtttacatgaaaaatgtgactctaatattgcaacaccgaaagaaatacagaaatgtattgatctagtgaagagtggccagttgaaactgagatttaaagctatttttattgatgaagttcagatttttgatcctcagtatctggaattgtgttatctgcttctggaggacgcagaagacaacgtgttcctgatggctggagatttgaatcagactgtccgcaagaagagtcaccggggagatgttccatggaaaaagattgcaggagtgcagttggactttaccggtagagttcgctacataaaaaagaactatcgaaacagtaaagcgattggaatgtatctatgcaaaatgcttgagcacatgaataatcgcatgacaatgcttgatatgattaattttaaggagtttgaatatgactcttttgagattggtgagaataagacattggcaatgaaaataataactggaattaatcgcatgccgattacagaacagacggttgctgcaattaaggagattgcaacaaagtacaatgtcagctattcagatattgctattctttttccatacaagcagcataaactgattaaatactattttctgtactggttagaaacggctttagataatgcggatattccgtactctctgattactgcctcgttagatgggacttttgatcgtaagcgttatagtgaaaccaacggagttattttatcgacgattgattcttctttgggtcttgattttaaagcagtaattgtaactggattatatccgtacaattacgtgttcggagataattactacaaaaagacaatttcttcatggagaactataaaggaaatgccggatgatgatcgggatcaggtacagagtcagatgcgctctatctatacggcatgttcacgggcaagagaggttttatatgtattaagtgatttgacagagggtactccaatggaggagatccttctgaagagataggagactgtgatggcgaataactacaatattatggcggagtatattgttgataaatacatcaagcgtatctccggaaaagatttaccagatatttttgtggaagatgatcctaccgaaaggattatggtaggaatgttggcggaagatcgcgtaaagacttcatttcagggaggatacatagagaatagtaatactcgatttgagagtgttccttctattagtctttcctttgtcgtaaagaagaatgcgcgtggtgttttgcgagttgttccacagggattattattctatactgttaagcctgattacgatatgacaatcacatatattctgaaaaagtattctgaaaaggataagcgcgaatatcggacatttgaagagttatgcgattgctatgacacagaaaaattgacacttccactcacatacaaaaaaattgatttttcaaaaatcatggctgacggaattgagattaatatggacggattaaagacttcaacttttagtctggagcaacagataaatgcgaaattgaaggaacttgcagattcagtagctagagaaatctgtattattactagcaccagagtgaattttgtggatctgttaagtccattatcgtttgagcgtgttttgtccattaagaatgaagtggttcaacctagatgggatatagatatcctagttcatgtgactgaagaaggcgaatacctgagatttcttatgcatatggtgaataagacttctgtagataagaagaatatgggatatcttcctagagtttttgatgcaaagatttttgttgttggaaatgagaatgttgagtttcagaatcttaaactggattatttcagtagtagttataaagagagagaaccgatctatgcagtcactgagaatactgcggtaaaatatgtaaatagaaatgacggaagtgtcgaagctttacagacagataatattccaatttattatcagttgcgcctgaaaactaaagatggattgaatgactatgttcagtttgataagttgctcgatgatccattgacaaatctgaaatatattctcggaaaaatggaagaggattatgctacttgtgaagatgaattagataatgcacagaacctttcaccacaggcagaagcaaagttcagacaggcattagaatattatgagggtgatgttgcaagatttagaagtggcattaagttgattgagtataaggaatttgtcaagaatgcgtttctttatatgaacgagacattcaaaactaaacttaatctcgaaactagaaagaatatcaaaggatggcgtcttttccagattgtatttattgtttcgatgataggagaagttgttcgaagtgaatataaggatgatcctttattgagcgaagccgataatgatatggcaaatttactgtatttccctaccggtgggggtaaaacagaggcgttcctcggtgttaccgtattcaacatgttctttgatcgcatccgtggtaagaatcagggtgtcacagcgttgttgaaatatccgctacgattacttgcagttcagcaactggatcgcgtattgactattgttatgcaggcgaacaaagtgcgagaaatacatcctcagttgaaaggaaccactgaattcagagtaggtttttatgttggacaaaataacactccgaatagaatcaaaatgtccgaacgattaagcaatcgtgacggtcagcagaagaatttggatttgattcttgacagtgatacggagactttgaatgagtattatcgttttattgatacctgtccttgttgtggtaagaaaacaattaatattcattttaatagagatcgctggacattagagcatatatgcgataatcctggttgtactgcacatacgttgcctctattcattgtggatagtgaaatctatcgctatctaccatctgttgttgttagtacgattgacaagatgtccatgattggtacaacaaacgagttcaagatgctttttgggcaggttaagaaatggtgtccgacacatggcttttctgtgaattcaaaatgcatgtgttccgattgcggatgtaatagacaggtgcaagatgtaggatatctaaaggatccggttccgaccttgtttatccaggatgagatgcatttgatcaaggaaagtctgggaacatttgattcccattacgagtcatttatctattactatgcaaagaatctggttaaaccggagcatagaaagaggattcgttttattggtgcaacggcgacaatttccatgtaccaggaacatattcagaacctttatcatatgcaggggcgaagattcccatgtgagtatccttccatgaaatgtggtgaggacttctactcatatactgatgatgaggatattacacgtatcattttaggttatgctccatatggatgttcaatcactgatggaatgtggcagtccgtgtattatatgcgattggtcgtttatcaaatgatcaagaactgggggcaggggtatcaggatctgtgcgaaaagggatttcagggaacagtagacgattatagaaatatgctgttcgattattggattgaacttgtatataacaatcgtaaacaggatgcaatggaactggaaaatgctttcaacaatcaaggcaataacttcttacaggcaaaaggtgtaccgctgtttgttccagagcagatgacgagtgacgttgatttccagactgtacgacagaccttgtttaatgtccagaaaaatagaaagaacctagatagtaccaatctgcttcttgcaactagtacaatctctcacggtgttgatgaggattcctttaacattatgtattttttcggaatgcctaataataatgcagagtatattcaggcttattcgagaacaggacgaaaacacacggggattgttatcgatataattcgtttgatgagaattcgtgaccgttcatacttgaaaaattttgttacctttcatcagaacaaggatgatcttgttgaatcagttcctatcaaccgatgggctaaaaatgcaatctatagcactttgcctggaattctttctggtgtattattacagtattataccattcggtgtggaatagatcatatgtatcatgcaataaaggccaagaaacttcttatggatggagcaatcgatcccgaagaagttgtgaggattattatcggtatttttgattgctcagatcgagagaaaatgtcgattgcgtataaagagattatagaggaagaggtaagaaatattcttggcggaattgagaatggtaattttgaaaaggacgaattcttatcaaatgctattggccagttctcgcatggaaaaataaagccgatgaaaagtttacgtgatacagaagaacagattgagataaagatttaaggtgaaatattatgaagcgaagtaaaaatcaagcagtatataaatttttacctaaagcatgggtatcagaacaagatgattccaatatggctgttactgcgcagatcactaaatggaattacaaagaaatgaagggaatctatgaggattttattgaagatgaaatccatcgccaaattgaattgtttggaaaaagagggggagatatttcttcttttgacctgcgtaaggatgtacattcttttgtggttgttgagccaaattgtattgaagatgtaccggatatcttcggaaaaatgtcaccgctggtattttactgcagttcctgtggaaaagtttttgagaagaaaaaggccagtgatgttgaaagtcatacctggtggtgctcaaatcctaactgcaagaaaagaactgtaaagcagttgcaaatgatctatacctgtgagtgcggttatgctcagccagttaaacttccgcttgttccgggcgtttctgagtttaagtactatccgaatgagaaaacttcacgattcaagatgttttatcaaaatgatcgcaaagttgcggaacttaggattcagtgtccaaactgcaatgcgacattgtttccagacaatgctaactctggaaagaactacaaggcatttactttatgtattgtaaatcttgtagatgatcgcagtggagctttctataaaaaaggaattgaggctaagaaagccattgttgcaaagtggtttggcaagatgagccaggctgaatatgaaaaaatccttgagaatgttgaattagcatttagtgatcgatttcgttccagtgcggagcgtgagagaatggagcaacaggttcgtggtcttattgcagcgcgatttgtgaaagaagaagattttgaccaggttgttaataaaatgctggtagatagtaatacagttagtgttgaaaagtatgcactggcttgtgatgatatctgcagacaatttgtgagtgacaatactgttgcgtatgaagaatggttgaataactattcatttaagttgatgcagtataatacagtaaaatatgcgcgaagagtaataacactgcaagattctatcaatcgtcagacagaaatggagtttatagattcgcctgaagacgtgtatgtttggcataggcgcttgggaattacaaatatgcaggtgtcttgtgatattcagattgttaattgcacatatggatatacaagaaaagcatttgatccattaaaaaacacaaacaaaaacacatctcttaagttaaatgcatacgaaaagaatacagagggaacggcacaccttgtctatggggcaaaacttgatacggagggaatcttattagagtttagtcagagaaggattattgaatggttagtagaaaaccatatcattcgtcgggaacagatcccggatttggatgatgaactggctgtgaaaaagtggtatgcagaaaatgtccgcagtaatctgatatctatgtttggtgatattgaaggagatgaacctattaccaagaatgtatttggattattgcattccatgtcacatgcattgctcaatgccgcgggcgagattagtggacttagtagtaattcgctaacggaaattatatttgtcgaaacagcaagtatttttatctatgcacaaacaagccagggagttccacttggagccttatccggcatggcagagatgagatatgaattctttttgagaagagtttacgaggattcaagaaactgtatcttcgatcctgtttgttctcagagagatgatacagcatgtcatgcatgtttggtcattcctgagatttcttgtaactattttaatgcaggacttggaagaaaatatatgtactcgaatgaaggagtacaaagtccgaaagtaggcttttgggagatgtaaataatggctgtaatgtatacgaaaaatataactgaatatatattccggaggattcagagcgaattgtttatgtgaagttgaagaatcagttgcctgcttcatttgaagttttttattcagttgggctcggagcttataaagaaagccaacataaagcattgttggaaattatcaggaaaaaatttgctattatggaagaaataagagatcgaagtcaactgatacatctatcggaattgttattcaagcaatttttgattgatgagcacttaacgaatgacagtctggtgatcataaccgagaattcagatgcattgatagatgaatttccggaaggcatagtaaaatggagatttacgaaacaggatcctgctagtgagaacgaaatcaaagtggcgtcagtagaagcgtataaggggcttgaagcggatatggtgatttacattcattctggcagcgtttcaaacaacatgaattatatagcccacaccagggcgaaatactatttaatcgaatttattaggagataatcccatggcaaagaatgcatcattcatacgatgggctggcgggaagggatggtttattcctgctgttcagaatatgattcaaaatatacaatttaataattatatcgaaccatttatgggaggtgcgtctattttcttttcattggatatcccgaatagagcgtacttatctgacataaatagtgagttggtaaatacatttgttcaaatcagagagaatcttgacgaagttacacagaaacttcgtgagtacaaaacggataaagattcatattacatgatacgagatcaggaaccgacagatctgattgaaaaagctgctaggtttttatacttgaatttctattcatttaatggtatttaccgtgtaaacagtaagggaaaattcaatgtaccttatggacgtagaagtggagaatttaattatgatcgcttggaagaaataagagagaaattacaggttgcagacatcagagaaagagatttttctgattgcaaagatgttattcatgcaggagatttagtttttttagatccaccatatgcagtggcaagcaaatcttcagataataatatgtttattgcttataatcaaaatctattttccttaacagatcaacagcgtttagcggagttgatagattatattgaagatgttggagcatattttattttaacgaatgcgcatcatcaggaaatcgcaaggatttttgaaggaagaggggaacgctttgagtttgatagaacctgcaacataggtggtaaggcagcaaaaaggggaaaagttcaagaatacatttttaccaatatatctggagtcgggagaaaggaggctgaaaaatagtgtctaaaacaaattgggaaaagatggttaatgaaaaaactataaattcggccaagagtgctcgtaggaaacaatttgatacattaaaaatcaaagcagacgatcttcttcaatatgttgatgaaggttgggaaaagtctaaggagtataagaatccaaaattcgtaggcattactaaggagaaggatgtacaagagcagtttgagaataggatatggatgttgtttgcgagcatgggcttttcaacaatgaatgctgatcgagagttctatatgtcatatgattttcatgatgaatcattggtacatcaagtggatgttctggcagtagatgatgaaaccattattattgtggaatgtcgtgcggctgatgagatgatagagcagaactttgcagcagacataaaagaattcagcgatcggatttctggcttgcgaaaagaagcattaaagaaatatccaaacagaaaatcaaagtttatttgggcgactcacaactatatcattcaaaagagggatcttattgcgttagataaagccggaataacatattttaatgattcagctgttgaatactattcagatctatccaaacatttgggttcttgttcaaggtatcagttactgggcagtttgttcgcaaatcaggagatcaagaatatggataacagaataccagctattcaggggaaaatgggcggttatacttattattctttctcaatcgagccagagaaattgttgaaggtaggatatgttctgcatcgtaatgaggcaaatcagaatatgatgccaacttatcagcgtattatcaagaaagctagactgacttctgtgcgaaatttcattaatgaaggaggatatttccctaactctatcatcatcagtattgatacaggtggaaaaggagtagtattcgaccaatccggaacaaaagttgagggatccatttctaaactgggaattcttcatataccgaaaaaatataggactgcttatataatagatggacaacatcgtttgtatggttactccgattcgaaatatgcaagtacaaatacagtgcctgtagtagcatttgttgatttggaacgtacagagcagataaaactttttatggatattaatgaaaatcagaaagcagttccgaaatcacttagagttacactgaatgcagatatgctgtgggaatcaaatgatttgaatgagagacgacaagctctcagatctaagattgctcagatgcttggagaagagccaacatccccacttcgttcacgtgttattgtgggtgaggcagaggcggcacccggaagatgcattacaattgaagcgattcaggcagcgttgaaaaagtgtaatttcttcaacgtctacaacaagaaaaatgaactgcaatcccaaggaacctttgatcttgatgataatcaagagtcctgcgatttattctatccgtttatcgagcattgtttcaaatatattagagagaattgtttagaagagtggaataaaggtgataaggaagatggtatgcttacgatcaaccgtggcattcatggtgtaattcgtgttattgacgatatcgtaaatatgttggttgaaaaagagatgattaatccgaaaacacaggaagttgaggatatgtttggtttgataagctattatttaaaaccattgactacttacatcagtgttttagaggcagaacagagaaaagaaatcaagaaggtttttggagggggcggagatattcgtttttggcgtgcatatcagaaagcaattgcggaggcaagacctgattttaagccagatgggttggatgaatattggctaaatgaggcaaagacatttaatgatacaacacggattatgattggtgaaattgagaacaagattaagactattatttccgataatcttgaggactattttggagatgcgtggttagttaagggccttccaaggaatatttacaccaaggcaaagaaaatggctgatgataggacgtatgatttgttattcaataacgatgatgctgatgatattaaaatatgggattttgttccgctgtcagactaccaggcaattgtcttgaacggaaagaactggtcaacattctttgaagatattatggttcgtccggaagaaacaaaaattgcaggcggaaaagaggctaagacacaatggattcttagattaagtgcaattaagaacaaactatcaaaggaatcttacagtgttccagttgatgaatatagctatgtaaaaagtattcatgattggattatggatatgcttactttgtaaatagtaagagagaataagccaatgtaacaatatagtacgagacatcttgcacacaaccatgtataagtttcattatgactccaactgaagtgctgataaccataagagaatttatgctagtactaaattacctggtaaaaatagactcattggaagttttatatagggaatttgtactggctagattattatgcatgagtgtcataactttggataaaaaagtgcatccatgaactaaatactattatcacagagggaaaaaatttctgaaaacttatgttatacgttgtttggaatgctgaaattaaaacggttgaaatagatatccacaaactcatttttctgtttttcgctttgactatgttaatgactttggtaactatacgcgggtaaaaaaattatagaatatattaatacatggatgaggtacaaggggagaagctacaatgagtaaaggagtaatttacatattgacttgaccaattcatcgtttccagattatgtgaaaatcggatatgcaaaggctttggaaaaagaatgaatcagttaaaacgaagtgaaactattccgtttgcattttgtgtatatgaaatatatgaggtggagtctaatttgacagatcttgtattgcatgatttattgataagttaaatccagatttacgctcaatagaaaattttgatggaaaagagcaaaaaagagaattctatgctatgagtccagaagttgcatataatttgctggattgtattgcaaaaattagtggaaccgaagagcgcttaaaaaatggcaccagaaggacatgagattttagataaacagacggcagctgaagtcgcaaaggaaatcagatgtggaccattcaaatttgcaagtatgatattctaaaacgtgcagaagttccttttattaatgacccgtccattgtcgcaaaggttgttaatgacagaaatatttcttataaaggagaaattacatctttatcggcattaacacaagaactgttagaatgtgattatcaggtacagggaactgcatattttagttgtcagggagaaaaactaacataaagaagagaacaattagaaaataaattccaaaaagatatggctcatatggttgtgatataaatttgggtatcacttaaattgaatactaaaaattgaaaaactataatatttaaaaacaaaggtcttatagttttttgcagaaaaataaaaaattacttcattcaccctgtttcctttcgttatatgaaggcaaaataaaaagttcctgactgtgtttgtaaaacaccctctgagcgttctgttatatgtaggacatggttggtttgctataaaaaaatcagtcctgattcaagaataatagtgaaaaaaagagaagtgaggaattaacattaacaaagtgagtttaatgggaagactgacaaaaaatccggaagtgaaatatctttagaatgacaataatactacaatggcaggatatgccctggcgttggatcgaaggtatcgagaggatgggaaagtgagaacagactttattttctgtgttacatttggcaagaatgcggagtttgtagagaaatatttgaataaaagtttgacgattgctatgagcggacgcattcaaaccgggaactatacgaattaagaaagtaacaagatttacaccacgaatgtagttgtcaagaaattgcacaaagactgaaaaaccagtatttataaggatttgagaggatataaaagggagtaaataaaggtgttatttatctgccacagcagccggccaagtatgtaaatggcaggggtctttatggggtgaatcggggcaaatcagtgcaaaagaggatcttcaggatttttagtattgttccgataaataaaaaatattattccgatggcattactattgttccgataatagggtatactgcgaatggaagagaggtgcagaattatgtttatatcggtaaaacaagccgcagagaaatggggcatttcagatagaagagtgcgaatcttatgttcagaaggaaaaatcccaggagtaattcgcgagggacgcagttggagaataccggtagatgtaaggaaaccggcggatggacgatataaggctacggaaaatttgctggagatgatcgacaaaaagaaggcagaattggactccagacgtccactgacagagggagaggtggagcgtctcacggaggaatttgtagtggaatacacctataattccaacgctattgagggaaatacgctgacacttcgagaaacggacatggtgctgcgcggactgacaattgacaaaaagccgctgaaagatcatatggaagcggtaggtcataaagaggccttttattttgtgcaagatttagtaaaagagcaggtaaccttatcagaaagcgtaataaagcagattcattatttggttctggctgataaaaaggatgaccgcgggatctataggagaattcctgtgagaattatgggagcgcagcatgaacctgtgcaaccttatcttattcaaccccaattggaacagttattagaaaattatagaaacagcacagaacatatcattcctaggctcgcacgatttcatatcgaatttgaaggaatccatccctttattgacggaaatggccgcacgggacggctacttgtaaatctggaattgatgaaaggtggatatccaccgattgatattaagtttgcagatcgaattgcctactataatgcttttgatgaatatcatgtcaagcataatttaggagcaatggaaaaattatttgcaggatatgtgaatgaaagactggagaaatatttgaaaatattagagaaatgaaaacaaatataagtaatagtataaaggaggcgaaaggttttaatgactagcacgtttcctaaaaatatgggactgtatgaaaggatgtattttgtctattttctggcctaaaaaagacattatagattttctccaaaaagtaggttgtactcaaagagtgctgatacttgagaatgaatataaagatcttcatagagcagaaattatagatagagtttcttgccaacctagaaaaacggagtgcttctaaacaagttgtatcagtttgctgcaaaagttgagggaaagatgtatggaaggggtatattcatttctataaatgttttctcaaatgattcagtacgagttcttacaataggcaaagcattaaatactattttagtagatggaggagatttagtattggcaacagaaggtttgtatacagttggggaaatgcttaataataaaataaaggctgcgcagacaatgggtaggatatgtgtcgattcaatcaatttgatgaataaaaatattgatgtctaagtgttattatgtttaaaatataatcgctcagttctgacagagttgccacgttgaggccgtggtattgatgtcatgaaccgttaaataaggaattgaaaaagtgtaggaaataaggtagttccgggagttgggactgtttggacaacagttctggctcccggattttttgtatggcaataaaataaaccacctgctctgcggttggtgggaagaactttagcttcaagcaagaacctcctatgataatatagaagtgggtccgccaaaactcacaaatagaaatcataggaggtatccaaaatggataaaaacagtttatcccatacaagatgggaatgcaagtatcatttggtttttgcaccaaagtatcgccgtcaagtaatatatggaaagattaaagcagatgtggcagaaatcttgagtatgttatgcaaaagaaaaggaatcgagataatcgaagcagaacgttgcaaagatcatatccatatgctagtacgaattccaccccaaattagtgtatcagaaattatgggatatttgaaagggaaatcatcactcatgatatttgaaaagaatgcaaaccagaaatacaagtatggaaacaggcatttctggtgtagagggtactacgtagatacggtagggaaaaatgcgaaaaagatacaggaatatattcagaatcaaataaaaaacgatttagagtatgaccagctaaccctcaacgaatacatagacccgttcacgggtgagccggtaagaaaaagcaggaaataaataatcctgaaaggataagttggtaagcaaagcaataagcaaatcccatagggatgagccggaataaggaggcactgagataagccctttagggttagcacgagattgggagtgcaagaagtggaccctctcagtgcgccatccgggcgcaagcagggatgagccccttataggggcagagcgacccccggctaagccggtggtcatgattgtatggcaataaaataaaccacctgctcttgatatgatacccacaactaggaaactaaaatataaaagcctacttgggggtattttatgtccagaaaaagtaagattgatgcactggagaaagtaaagattgtagagcagtatctagatggagagattagtcaaaaaggttctgctaaagcatgcggtgtaaacaaacggagtgttaaggattggatcaggatctatgagacagaaggtccggaaggattattgacaccgaaaacgaataaacgatattcaaaagacttaaagctgcaggcagtacaggcctatctttctggtgagggatctttgaatgaaatatgtgcaagattcggaagccggtagcatgttcagcgtatgagttggattaaggtgtataatgaaggtaaggaatttaaagaacttaccggaggtagcactatgaagaaagccagaaaaacgatattggaagaacagattgcaatagtaaaagactgcctttcccataatcgcaattacggagcaatggctcttaaatataattgttcttatcagcaggtacgaaattgggtagactgctatgaaaagattaggagtacaggactggagggccgacgaagaaagcgtgccggtttctagacaagccgcacatcagaagaagaactccggaaccgcatagcagaactggaacgaaaaagcatagatccccaaatggaggatggcctgttaaaaaagtaagggaattggaaagggggcatcgctttctctaatacataaattacatgtaatgaaaccaattgaatttaacgaacttgcattgcaggcagcgtataaataccgccagacagtactggctgactgaagaaaaattattgtttttcattgtcctcttgacggggagcacgccatccacttggtggtaattattttaaattcatttgacaaattgattgatttacagatatatgcgaatgagatgcaagatttggcatgaacatgagaagatggatattttatagatagttctatcaatataccgcttaatcgtaaccatccgagtatagagcctatagcacttacaagataggttgcgccgccaacctaattattactagtatagggacttaaatgaagaagttgtgatcataaatcatagcgaatattgatctatttacacttagttgacaatcttgataaaaaagaatacaatatatatgactaaatagaaataaatggtcatatagaatggaggaacaattatgccaaaattcagcgatgctgaaaaagagtttataagacaaaaactaatgcaagagggagaacgattatttgtctcattcggaataaaaaaagtatccattgatgaaatcgtacaggccaccggcatagcaaagggctcattttactccttctaccaaagcaaggaacatctgtatatggatattgcggggaatctgcagatgaggatgtggcaggagatggatgaatttttaaatgaaaatcgttcgttatcaccaagggaactttgtaaacaatgttttttatggatgtttgacgagttgcaacgttatccgatgcttaagcaagctaatggcgagacggctgactatttatatcgtaaattgccccgtgaagtgattgaggcgcatacaaaagatgacagtcatgaacttgtaaaattgcaggaatatggcgttcgttttaaatgtggaattgaaattgcaacaaaaacattacagacacttgcaattagtttcctaaacttacaacaggataatgctgaagatcagcggactataatgggaattattttggatggcgtattaaaggagattgtcagtgatgaaaatgattgatgtccaaaatgtatttttcaaatatccatcttcagaaaacgataccattaaggggatttgttttaaggtggagcagggggaaatatttggcttccttggtccgtcgggtgctggaaaaagcaccatgcagaaaatattgacagggactcttagggattatcgagggagcgttcacgtttttgatacagagataaagcgtagaacgagcgattattatgaaaatataggagttgattttgaatttccaaatttttatggaaagtttaccgcgatcgaaaatttgaagtatttcgcctccctttattcagttaaaacaatggatccaatggaactcttagaaaaggttggccttcatcacgacgccaaaaagaaggtgtccagttattcaaagggaatgaaaatgaggctaggattcgtgcgttctctgctgaatgatccgaaactgctgtttcttgacgagcccaccagcggccttgatcctgcgaatgcaagggtattaaaggatatgatactagagcaaaaaaggatgggaaagaccatcattctgacaacccataacatgcatgatgcggaggaactctgtgaccgtgtggcatttatcgttgacggtacaattaaaacaattggttcgccgcatgatttgcgtaagagtggatcagatacaaaggtggaatacagttatatagaaggcggaaaggaaataagaaacgtctgtacgctatcccacttggctgattcgccagattttcaatctgcactgaaaagaggtattctgacaagtattcattcaaaggagcagacgcttgaagatatatttatagaactgacaggaaggggattgcagtgagaatcttaaatgccataaaaaatgacatccgttttcagataaaatatggtttctattttctgtatttctttttcaccgtggtttatatcgttgcattgaggataacgccttcggaatataagaatatggcagcatcactcattatactgacggatcccgcaatgcttggtgttttctttatgggaggcatatggctgcttgaaaaaggggaggggctgcatcgcttttggagcatttcaccgcttcggacgatcgaatatgtatggtcaaaagccatatcactttctattctgtcaacaatttctgccatactaattgtcctgattgggataggaggaaggatcagattcatatttttggccttatgcatatttataggagccatcgtatttaatctaatcggacttctggttgcttcttatgcgcattcggttaatcattatatgataatagtaatttttccaacagtagtactgtcattaccacctgtttttactgcgtttggaatcacttatccgtttttcgaaatatttccgggcacagccttgtggcatatgattgaaagcgcatttttttgggaaaaaagtataaatggctggattggaattaatcttattctctggtttggagtattgtcagtcgtggcaaataaacgtatcggtgtcgcattgcagtcagcaggaggcgaaggcgtatgaagcatacaatgaaactatttgaaataggcatgaaacaagtattaaaagatggcatgctgatagccttgattccagcgccatttttagttggcctgtttataaagcttgccattccgtttatcaatcagatattaacaaaagagttttcattttctataatagcctggtatggcctgatagatggtatgctgatatgcctgactcccatgtttgtggcgatgatatcgtcattcctgattttagaagaaagagatgaaagattaagcgatttctatcagattacaccggcagaaggctactcctatttatttgcgcgaattggcctgccaatgatatgggcattcgctgtcacaatgattgtttctaaaattttcaatatatcatccttatctacgttcaccattctagactgttccataatcagcggttttacaggcatatttctggcaatgatggtcgtttcgattgctggaaaccgtgtggaagggcttgcgctttcaaaactgatggggattagttttatcggactcattctaatatggtttctccctgcgccttatcatttcctaatggcttttcttccatcattctggattgggaaaatactgctcgacggagcaagtttcttttcctttatacttggactgatatcttgctttttgtggattgccttattcacaaggaggtttttgaaaagagtatagcgagagatttatcacttctaagatacacataaaactttggcctaattctgtttgcgtgtattctatgtctggtgggacttctttaaattatatccggggatatcttccatatgacggcacaaatccgatcctttgaatttttaagaaaagtcattgacaaacaacgaattataaattatactgagtatagttttataaaaggggtgtcattaaacaatgaaaaataaaaaaggagttgcattatggagactatagcatttaagtcatcttggaaacacgctgtattagagtaccagattaaggagattgacacgaatcaagatttatctaggtccgccattaccaatagggcaattgatgcagccaggaatgtcgaagattggggaaaggtaaaggatgatttagcattgctaaaaagaatggatatttctattgctacatcaatgcaagccaagcctgatgaagaaagagcagaaaaagtacgagaaattcgtaagaagatgtttctggacctgaaaaatgtaataccagatctaaagcggctgcagacaccatattttatgcagttgctttggatgaattatctgaatgaattgaaaaaaaggaaaatggctgtcggaaaaaccatctcagattccgtagatttatctggacctgacatggtaaaaagacttgtacaaatattactgcttaaccgagaggcagataatgaagtgatagaaaaagtcaaaaatgctttattagaatgggaggaataagatatggcagatgttgtattaaaccaaaacgaaatggatgattacgcttcgcatattttccccgtgatagttcatgcatcttcaggaacacatttgaattacccggatgatttcttcgtaaagcgaacggcatccctgcgtcttggtagatatctattcgaacaggttgatcatggaaatttgaaagggacactgcattgccttggctcacactcgaaagatggctatgttaaattatgattatggggctatgattttgaatcagttagaagcaaaaaggcgtattatcaaatatcttaaagaacataacattccatatatggaaggcttatgtggagacgctcctcagattacaatgttgtataaaggatgtgaaaactgtcccgataaggttttagaatcgagtatctactttttctcagactgcgcagaatgtagagtctattataacgcaaacggagcagaatgggttcggataagtaattgccgtaatgaccttttcagactatttaactatattaatgctatgatatggccatgcggtgcggatggcgtgggtaataatttatataaaccacaacatttgtatactccaaggctgtatatgacggaagacgattgctttgatatcgtgcttgcaacagttgttaattatgatttttacaatgttgcgcctctggagacagaagacttcttaacagcatgtttgccagagttgctcaataatctgagcatacctatatttttacttctccttggcaagataacggttgaacgagcaatatcaataatagaaactgagatacttgataaaagaggaactattttatgaaagaagaattagaacagcagttagagcatgattttccatttatgcagaaaagcagagtcaaggaagaaagaaatacatataaaatatttgggtgtgagtgtggcgatggatggtatgggcttatctatgaactttgccaatcaattactgaccgatatgtaaaagaggagatcttaccggaaaatatagatctgatcccgatacaaattaaagaaaagttcggtatcctcagttattattacagttttaaagatatgccatgtaaggagtctgtcgatgattctaaaaagaaattgcgttttgatattgcatgtatcgttcataattatcaagagaaaagcatgtcaatatgcgagaactgtgggaagagtgggaaactaaggtcagatttgccttgggaacaaactttgtgcgatcaatgttatgagaaatgtccgaataaactgaagaggaaacaataagaaaattgatactttgactgtaagagcatcaatcctgatcggattggtgctttttatctgctgtagggagcaagggtattgaaagcaacaatgctttgaattctgctattttgagtatttgcttaaaataggacatggaatgtcatgtatatgcggtataataagtatgaggtgacattttatgaaagaaaatagatattttcaaatgatttatttgttgctggaaaaaggcagtatgactgctccagaattagcagattattttgaagtgtcggtaaggactatatacagggatattgatatcttaagttctgccggcataccggtatatgccacccgggggaaaggcggcggcatatctattcaagataatttcgtgctcaaaaagtctatcttaagcgaacaagagcagacgcaaatacttatggctttgcagggaattagaatagttgaagatgaatatacgagaactctcctatcgaaactgagcagcgtgtttcaaaagcagaatgtaaactggcttgaaattgatttctcaagttggacaaaaagcggggcaggaaaagataactttcaaaaactacaaagtgctatatttaagagtaagatagttgcatttcattattacagcggcaaaggcgaagtgatcaaacgagtcgtagaaccacttaaactggtcttcaagagtacggactggtacttatatggttattgctctacccgtaacgatttccgattttttaaattaactcgtataagaaatctcgaaattaccaacgacgagtatgttcgttccattccagaacaaatatttgtggaagaagaaaaatttgaaatggaaacggtaaaagtaacgcttttatttgataaaagtatgtcttttcgagtgtacgataagtttgacgatgaagtaaccgaaaatcaagatggtagtttattagtggaaaccgttatgccaaataatgaattattaattagccatatcctttcttggggggataaagtggaagtaatttcaccccaaaacattcgcaataaagtatctgaaagagcaaaaaagatttatgaaaattataaaacatgacacggcgttgcaagttatgtatgatattatcatatcaacatatcaaacgcaacgtgtctcatgaataaagcagaatagataatctactctgcatataaaagcaaaacgaggataagaaagcaggggtgatacgaagtgtaaatcttcctgatattttgtcaaaatgcagataggcaaatttaatgaacgccatgcaatgaaatatgttaaatgttaaagcgtcagtacagttgtagtactaatgtgatggtatcaatatattaggaggatccggaatgataaaaaaggctttagtagtaatagatattcaaaatgatataactaagaattacaaagaaataattgcaaatataaacaaatccatagattgggcaatagaaaaaaatattcatgttgtgtacataagacatgaaaatttatcaagcggaaccagaactttcaaacccgatacatgcggggctgaactggcttcggatttgaaaatagtttcaaaaaatattttcacaaaatacaaaggaaacgcattaaccagtgaggagttctcaaacttcataaataaaaatgaaatatgtcatttctatataacaggagcggatgctgttgcctgtgttaaatcaacctgctacaacttacgtaaagcaaattatgatgttagtgtactgacagattgcatcactagttatgataaaaggaaaattgacgaaatgctgcgatattacgagagcaaaggctgcaaactgattggtttgaatgatttgttgaattcatgagttgatctaagcattctaaaagactaaagatttaacctgacttattgtagagttatttatttaagggggtgcttagatgacaaaataatgataatatagtttatgaaaagaagattgagtgcggataaaacatactgaattggggatcgataaatcgagaaagaggaagtttccgatcgatgtagaaggtatggaagattgcatgaagtctagataaaataagatatgtaaggggctttataaacatgataaaaattctatttgtctgtcacggcaacatctgtcgctcccctatggcagaatttttatttcgtgatatgatccgaaaaaacggactgcaagataagttcagcattgcttcagcagccaccagccaggaggaacttggcaatccggtacactatggcactgtacagaaattaaaagaatgtggtattagcgcagaggggaaatacgccactttgatgacgaagaaagattatgaaaaatacgattacctgattggcatggagcagagaaatgtgaaaaacatgctgaggattctaggaagcgatccggagcaaaaagtatatagattactggatttttctgaatcgccaagagatattgcagatccatggtatacaggaaactttgatagaacgtatgaggatatttatgagggatgccaaggactgctggaagaagtaacacgaagaaggtaacacgtaacatttttaagatggacacgtaacaaagttaaaaagtgttacgtgttaaccttctacaactggtgtgtaaatttgaataaacccctgtgtcaaaatgaaaaaaggtagtggcaaacgatagtttagcagaaaatgctgactaacctcatagaaatataggcttttgcagatttatttaattttgcgcaccattattttcagattgacacagggaattttgcagttttacacaccagttatgtaggtttgacacgtaacacttttaaatattgttacgtgtccatcttaaaaatgttacgtgttagttagttccatttcccccgcaaatatgctactataagcatacaaagcacaacaggcaggaaaaatcgaggtgattggattgcgttacggagcggtggttacagtggcggagatttcttctcagatgggcgagtttaagccgatgctgccaatcgggaaggaaacgatgatacagcgagtcgtgcggacgcttaggaaagcagacgtagagaatgtagttgttattacggggtatcgccatgaggtaatcgaagaaaatttaaattatgcgggcgttatgtttttgaaaaacgaacgcttcattcagggagactggattgattcggtaaagatggggctgaaatggcttgatgaaaagtgcgataagatagtagtcattccgggagatgttcccatggtaacggaagatacgatacgggaattgcttgcacaggcgggaggattcacatacccgacatttcagggagagcccggataccctgtcgtattaggcggtcaggcagcctctcgggtaacaaatgtcatatcaacagaacaaggttcaactcaaggttcaattcagccaaatgccatagaggatctgttgaaaataatgaagggattgggtatcccggttacaaaactggcagtagaagatgtgggagtaacgcttcagatcaattcgcagaaggactatgagaaggcgttgaggctttatctggacgaagcaggccgtattgaccaggttcgggttattaccaagacgatgcttgctacggatgagaagttttttggaaatggaacggaacagcttctggaactcattggggtcaccggttctgtgaatgcggcctgccaggccatgcagatgtcttatactaaggcctggaagatgattaaccgcattgaaaagaaattaggctaccgggtgatggaacgagttgcgggaggccgggagggcggaggctctcaacttacggaagaaggcgaaaggctgctgcgggtataccggaagatgagggaagaagtgcaggctgctgcggaaataagttttcaaaagtatctatcggacattctgggataggcttgaagtttgaagaggcgcataaggctgtgaaagagaggaaggggaaagatgagaaaattattctctatactaaaggatacgctgcagagcgggcaggatgccgtgctggtatccgtggtggcaagttcgggctccgcgccccggggcgcgggagcgcatatgctggttacaaggaaggggcgcgtcagagggacggtaggcggcggcgcggtagagcatgagtgcattcagcgagccttgggagtgcttgacagcaagaactcccatttggaagaattcaggcttcacccgaatcaggcagcggatcttggcatggtttgcggaggagatataagtgtttttttcaggtacatgccatcgggagacgaacagatgatagatctggccataagagccatccggatgtttgaccaggatcgaaagtgctggctggcaatggatctttcaaaagaagggaagggacagatgtatctttatgaagaaggggatttgccaaaaaaagtgcaagttgccgtatgtgccaaagcaaggtcggagccacaggacagtcctgcgaaatactatttggaaaaattagtgcaaggcagcaaagtttatattttcggcggcggccatgtggcccaggaggcggttcctacgcttgcaagggtcaattttgactgtattgtactggaagacagggaagactttgcaaagccagaattatttccgggggcgagaaggacgcggctggttgatatggagcatctggaagaagtatgcagggacatcacgtccgatgactatatttgtgtcatgaccagaggccatcagcacgactttctggtagaaaagcagattttgcgcacgccggcatcttacataggagtgatcggaagcagaaaaaagaaggaggcggtctttgcaaaactccgccaggaggggtatacagaccaggatctggcaaggatcaagacgccgatggggctggatatccaggcagagacgccagcagaaatagcggtcagcattgcggcggagatgattatggagcgagcccgtcgtaatcacatcgagagaccaaacgaaggagggaaagagccatgcgtctgattaagacggaggaagcagttggccatgtgctatgccatgatatcacgcagatcatcaagggagtgaccaaggatgccgtattcagaaaaggccatatcgtgagagaagaggatatcccagtacttctttccgtgggaaaagagaatctctatgtctgggagaagcaggaaggtatcctgcatgagaatgaagccgcgcagattttgtgccgaatgtgcaagggggccaatatgcacccaacggaagtcaaggaaggcaagattgaactgatcgcagactgcgacggcgtattaaagattgatgtggagaagatgaatgcggtaaaccgtctgggagagatgatgattgccagccgccacggcaactttccggtaaagaaaggcgacaagattgcgggaaccaggattatcccgctggtcattgaagaagagaagatgaggcgggcagaggccctgacacagggagaaccgattttccaaatcgtgacttaccaaaagaagcgcgcaggagttatcactaccggaagcgaagtatataagcaccggattgaggataatttcacccccgtgatcgaagctaagctaaaggaatatggcgtggagatggaagaccatgcggtctgcgatgacaagccggaaatgattacagaagccatacataagatgctcgataaaggaatggacatgatcatttgcacaggaggcatgagcgtggatccggatgaccgtacgccgctggcgatcaagaacgtggcggaggatatcgtgacttatggcgcgccggttcttccgggggcaatgttcatgctggcttattacaatggagatattcccgtcatgggattgccgggctgcgtcatgtatgcgaaaaggaccatatttgatctggtgcttccaagagtgctgtgcaacgagaagttaaaagcagaagatttgtccagacttggacagggaggcttatgcttgtcctgtcctgcttgtacgtttccaaactgcgggttcggaaaaggagcgtaatcgatgaaggatcaatatggcagggagatcgattacctggctcggacggaatcttaaaactatgtctcaattacgagagtgatcggaatataaaggcattgatgagaaatggagcagacgatgccagactgaaagaatagtaaaaacagtctgtatcggcgaacgcagaggtactcaggctttggtcttccaagcctgccggtgggaacggtgtttcgctgcaatgatgtgctgcttgagatgacgcagtttgggaaggaacgccactctccttgccagatctatcagaagatgggggaatacattatgccaacccaaggcgtatttgcaaaggttttaacgggcggcatgatagcggcaggtgaagagagaagtattgagaagtgaaggccttttttcgtagtatcttgcttttcaatagaagccgtattgggaatacgataaataaaaggagaaagttttatgaaaaagagagtggtggcagtatttatggcagcagtgatggtattaggacttgcaagttgcggaagcagcgaggcaaagaagacggatggcaaggacaagaaggcctcggaggaatccaagaaggatgacgcagatgagacggaggtccaagtgtttatcgcggcaagcctgaataccgtcatgacggaaatcgcggaaaagtataataaagacaatccggatgtgaagattaccttcaatgcggatagttccggcaccctgctgacccagatcgaggaagggtatgaatgtgatattttcttttcggctgcccagaagcagatggaccagctggaacaggatgggctggtccgggaaggaacccgcgcaaatgtggtgaataaccaggtggtgcttgtgacccggaaggacagcggaaccaaggcaagcggacttgaggacctgaaggatgcccagagcatcgcgctggcaggcggaagcgttccggtgggcaagtacaccaggcaggcgcttgtgaatctgggcatcctggaaaagacggatgagcccgatgcagtcactacagaacaaatatcagaagcgcttggcggcgtggagatcagcgagcaggataatgtaagcaaggttctggcagcagtggtggaaggctcctgcgaagtaggcaccacgtattattccgatacctatggttatgaggatgatctggatatactggagacggtaggctacgatctgacaggaaacgtgatttacccgatctgcctggtagataatcaagaagcggatgaggcccagagcagggctgcaaaagatttttatgattatgtgttatccgaggatgccagcgagattttctacaattattattttgacaccaacgtacagagataaacagaatgagataccaaaaggaggaatcatctatggaggaaatatgcgcagtcctgcaggacttggactggagcccgctttatatctcgctgaagacaggagtggtggcaaccgtaatctcctttttcctggggttattcgcagccaggaaggtgatcaaggcaggtccgaaaataaaggctgtggcggatgggctgcttacgcttcccatggtgctgccacctacagtggcgggcttcttccttcttcttctgttcagcagaagaaggccgcttggcatgttcctgtatgatcaattcgatatcaaagtggtacaaagctggcttggatgcattattgcggcgacggtgatcgcattcccgctgatgtaccggaatgccagggcagcgtttgagcagatcgatgtaaatctggtctatgcaggacggactctggggatgagcgaggctaagattttctggaaagtagtgattcctacggcggggcccgggattatctcaggaaccatcctgacatttgcgagggcactgggagagtacggggccacttccatgcttgccggaaacattcccggcaagacggggaccatttcccagaagattgccatggtcatccaggatggcgattatctgactgcgggagtctgggtaattatcgtgcttatcatcgcatttgtcgtcatcttcctgatgaatcttttcaccggcaggaatatgaaaaacgtcaagcgctggtaaaaatacggacagaaggagaagggcagtggcaatcgaagttaggatgaagaagaaactgggaaattttcaattggatattgattttaaaacggatgagaaccggatcggcatcctgggagcctcaggctgcggaaaaagcatgactttgaaatgcatcgcaggcatcgagacgccggatgaggggcggatcattgtggatgggacgctgctgtatgattcggcgaaaaagatcagcctgaagccccagaagagacatatcggctacctcttccagaattacgccctgttccctaccatgacggtggaggagaatatagcagcaggactacagggagggaaagaggagaaacgaagaaaggttgcaaagatgatggaaaagttccagctgctggggcttggaaagcagctgccgggggaactctctggcggccagcagcagagggtggctttggcaaggatcatggcctatgagccggaagccatcctgctggacgagccgttctccgcattggatgaattcttgaaagacaggcttgcgcaggagatgctggacctgctgaaggattaccggggaacggtcattctcgtatcccacagccgggacgagatctaccggtttaccagggaacttctggctatggcggatggaaggcagattagttacggagacacccgggagatctttgcaaacccagggaggaaggagacggcacgcctgaccgggtgcaagaacattgcaggggcgagaaggatagaccgctgtcatcttgaagtgccggaatgggggattactctgcgcttgaatgaaaacatcccggaaaaggtggcgttcgtcggattccgggcccatgaatttgtccccgtgtggggtgaggcggagagtaactgcattcctgtgaacattaaaagcagcgcagccctgccatttgaaagaaagtatttcctggcgggcgcagagggaagcgaggaggatatctgctggtttctgcaaaaggataaatggcctttgatcgacaggaagggaatgccggacttccttatgatgccggaagagaagatcttgctgctggaatagcgataccatttcttttttttcatggctgtggtagaatacgactaatggaacgtgtttaagataggggagagagttgagcatgtataagcggatggatcctgtcatagcaatgcaaaaggagggataaaggtggtcgaattaaatgaagaagcaaaagaatacatgcaaaggttcggctggaagcatgtggtacttaatgttgagagtataaccagctgatgcgcgcctccatataaggagatgtcggtaagttttaccgatgaggatgaagtggcgatgctggagaaggggtatgagacggaccaaagcgagttgggaaacgtatattacccaagggagggaataaaaatcccggatcatattatcgtaaagtatgtagaatatccctgggtcacctgcttcgaggtggaagggatagaaatcatcaaagaggcaatgcaacaggatattaaggaataggcgagagccctccggaacgtatttccggagggctttttgacgtccttatagtagctgccaagccatctggtacaggatcggcgggaaataaacccctaatggggttacttctgaggaagagggatgctataataatcataaagcagaaataatagggcagtccaagaggctgctggaggattcttacatgaaggataatcgggccagatttggtaaaataaagatcaaagacttaatgattatatggattctagttacgcttggcgtgattgtcatgctgttcgagacatttcacgccgcgtcccaggccgtcgggaaccagaagtcagtgacggaaaagaatatgcgctgccttgaactggcgcagcaggtgcaatccggctcagatgtgctgacagatgccgtgtggagattcgtggccactggggatgtgcagtatgcggaagaatatctgaaagaagtggaggtcacgcgctccagggaccaggcgattttgaaattgaggaaagaggggctttctaaggaagaactccagctgatggaagatgccaaggaagaatccgatgaactgatggttcaggaacttgagtgtatgaagctggtatatgaatctgaggggatagaagaattgccatcggctattgcgaatgtgcagttaagcgaagaagaccaagggctttccggcggggagaagagggcagaggcgcttcggttcgtgtttggcgatgaatatgccagagctaaggctgcgatttcaaatgagatagatatatttaccgaaagcctcgataagaggcagagcaaggaagtattccaggcaatgcgatatacggataaggcccagaggctgcagcagattacggcgatattgctgcttgcatggtgcataggcttccagatttttttctactggatcgtgatccgcccgatccatgcctgctgccgggaactggatgatgcgaagaaccgggagcgaggacttaagccgcaggggtcgtatgaactgcaatgcctgatttcggcgttcaataaatcaatttcccagatccaggataagaagaaggagattgcggatatccagatggtagatcctgtgacaggaggatatacggcaactagatttgatctggaaatggtgaaatacctacaggaagagaaaaggtttgcgctggcatccatggatatccggcgttttaagttaattaatgacgtatatggaagttcggaaggagatggggttctcaaagaggtctatggcgcggtatgcagctgcctgaggccaggagaatgtgtctcgagaattcagtcggatatttttaatatcctgctgtgcgagacggatatccggcagatcgaattccggcttgatgagatcaatgatcgaattgaccggatggttggagacgggcgcaagaagaattaccatctttctcttaactgcggagtatatcaagtggaacatggaaggcaggatgttgtaagcatccgggacagggctaatgtggcgcgcaatatcagcaagagcgaatccggttacttgaagggctgcgtattctatacggaactggaacggcatcagcttctgaaggagcagacgctggaaaatgcgatggaaggggcgcttcagtcggaagagttcctggtatatctgcagccgaagatacgattatcagacgggcgggctgtgggagcggaagcgctggtaagatggaagtccgaagagtacgggctgataccgccggatgaatttattccgttatttgagaagaacgggtttattctgaaactggattattacatgttcgagcatgtgtgccgcctcctaaggaactggctggacagccataagaaggtgctcccgatttctgtcaatctttcccggatgcatttgggagaggcaggatttatccagcggtataaggagatacaggaaagataccgaattccctgcgaactgctggaatttgaactgacagaggcgatggtgtttgaagatctgccgcggctaaaggagattattgcggaacttcacgaggcaggataccggtgttccatggatgattttggaagcggatactcttccttgaatgtgttgaaagatataccagtagacatcctgaaactggacagaggcttctttatgggcggcgagacggagcggggagtcaacgtagtgaaggctgttcttcatatggccagggaactgcatatgaaaacggtggcggaaggcattgaaaccagcagccttgtgaacttcctgaaggaagaaggctgcgacatggtgcagggatacgtgttctacaagcctatgccagcccgggaatttgaatacgagatactggagaaagaaagtgggacggttgtatgaaacgcgagatagacatgagtgaaatatcagatggaaaattatatacggcaaatgacatggtaagggcagactgccatgactgcgaggggtgttctgcctgctgtaaaggaatggggaattcgatcattttagatcctctggatgtatggcggctgtgcaatggactttctctggattttgacggcctgctggaaagatgcctggaactgcacgtggtggatggaatgatacttcccaacttgagaatggatggggagggcgaagcgtgcacgtttctggatgaacagggaagatgcgccgtccacccacaccggccgggcatatgcaggctgtttccgttgggaagatattatgaggaagagggttttaagtattttctgcaggttcacgagtgcaggaagaaggaccggggcaagatcaaggtgaaaaaatgggtggatgcgccggacctgaaggcttatgaaaagtatatctttagctggcatgattttttaagaaagtgcgaagaaggattaaacggactggatgaagagcaggcaaggatcctgaacctttatgtcttaaaaacgttttaccagactgcatatccaaaggatccgcaggcacaggcattttatgaagagtatagccgcaggcttgcgcaggcggaggcgacgctgggattggaggtgtccgcatgtatatagcagatctgcatatccactcccgctattcccgggccaccagcaaggactgtaccccggagcatctggatcttggggcaaggcgcaaaggaatccaccttgtggggaccggggactttacccaccccgcatggagggaagaactaagggagaagcttgtgccggctgaagacgggctctatgtattaaaggaggagtaccagattcaggacgaaacctgtacagatagaataattccccgattcgtgattaccggggagatcagttccatctataaaaagaacggaagagtgaggaaggtacacagcctgattctgcttcctggccttgaggaggcggaggtgatatccaggaaactggaggccatcggaaatatccattctgatggaaggccgatcctggggctggactgccgcgatctgctggagatcgtgctggaactctgtcccgaggcgatctttgtcccggcccatatctggacgcctcatttttcattgtttggcgcgttctccggatttgatacggtggaagaatgcttcgaggacttgtcgccctacatccatgccatggagaccggactttcttcggacccgcccatgaactggcgggtatctgccctggattcctatcatctgatctccaattcggacgcccattctccggcaaaactgggaagggaagccaaccttctggatatcgaactctcctatcaaggcctctatgatgcgatccagaaggggcagggactgtctggcactatagaattctttccggaagaggggaagtatcattttgacgggcaccggaaatgcaacctttgcctgagtcctctggacacggagaaatatcagggaatctgtccggtgtgcaaaagaaagattaccatcggcgtttcccaccgggtagagcagctggcggaccgggcagaaggctatgtaagagcggatgccaggccattcgagagtctggtgcctttgccggaagtcatcggcgcttcggtagggcactcggcagccagcgccagggtgcagaaggaatatcagaacatgctgcgacgcctggggccggagtttgatattttaagaaccatgcctttggaggaaatacgcagcgtgtcgggatatctgatatccgagggaatcggaaggctgcgggaaggcaaggtagagaggattcccgggtttgacggggaatacgggactataaaattattcgctccttcagaaatagaaaataccagcggccagatggacttctttgatctgctgggaggaaagggcgaaggcgatggaaaaggcgccaaagcaaaagatggggcaaatgcagccatagaagagggaataactcccgtgaaagtaaagcagccagtagaagacggcacgcagcaaggctcaggttccccattaccgctgcctgacaagctcaaccgcgagcaggagcaggcagtacggtctacagccaggacggtagccgtaatcgcggggccaggcacaggaaagaccaagaccttgatcagccatatcctgtatctgatagaaaatagaaaagtaaagcccggggagattacagcggttacatttaccaatcaggcggcgtcccagatgagggagaggctcaggaatgcgctgggaaagaagaagcagatccatacgatgcagatcggaaccttccacgccatctgcctggcatttctgaaagaccagggcagggaattttctattctggatgaagaaggggcgcaggagatcgcgcgcgggattattgaagaataccagttaaaggacacggtgaagaagttcttatacagggtgtctggctggaaggcagaaggagaagtgccgcaggaggacacggacgcattcctcgcctatcagaaatatctggaagaaaggcggcttcttgatttcgacgaccttctgctggagacattgaagctgatagaagaaccacaggcttctgcggggtgggagaagcatttttcctatcttctggtggacgagttccaggacatcaatcctttgcagtaccgcctgcttaaggcatggaataaaaagggccgcgagttgttcgtgatcggcgacccggatcagtccatctatggattccgtggagcggatgccggttgctttgaccggcttgtcgaggaacatgcgggtacggatgtgataaggcttgcagagaattaccgttccacgccccagatcctgaatgccgctctcgcagtgatctcccataatcccggagaagacagaagacttgctgccaaccgggaggatggcgatagggcgcgcttggtgacggcagagtcggggatgggagaagccatctttattgccaaggagatcaaccgcctggccggagggattggaatgctggaagcccatgaattatccggtgccgtcaggacagaaggccgggtccggggatttgacgagattgccatattgtaccgaaccaaccatcagggggatctgctggagaaatgcctgaagaaggaagggattccctatattgttgcgggaagaggatcatttctgcaggaagaaaaagtacggggaagcatcttcttcttccgttatcttgacaatcccatggatatcctggcgaaggagcagtgtcttagacttctgtggaatatggatggcaatctggccgcggaagaagtgctggaaaggatggcgggcaagtaccgtcctctataccagaagaaaaaaccgcagaagttcctggaactgtggatggaggaactgcagctggaagataatgaggcggtgaagaaactggcgggcatgggcgtattttataagacgatggcggaattcatgtcggcggtccaattaggaatagaaagcgatatcaagcggtgcgggaaccgggactacgcttcaggagcggttaccttgatgacgcttcacggcgcgaagggcctggaattcccggttacctttatctatggggcaaggaagggactgattcctctggaaagtgaaaaggggaaaacagatctggaagaggaacgcaggcttctgtatgtaggcatgacaagggcgatggaggaattgattctaacgacgtcaaaagaggcatccgggtttctggaagggttgccgtcagaactgctggagagagaaacggcacacaaaaggagggtagaacagtgccatcagatgagtttgtttgaactgtaaatggaaacggcttggactatgtttcacacagagaatggaggaattcgtatgagtgaagaacaggtaagaaggatgcatgatggcaaaggattcatagcggctctggaccagagcggcggcagcacgccaaaggcccttaagaattacgggattggcgaagaccggtaccagtcggaagaagagatgtttgacatgatccatcagatgcgtacaaggattatcgcaagtccttcgttcacatccgagcacatacttgcggcaattctgtttgaaatgaccatggaccggaagattcatggcaagtacacggcggattatctgattgaaaagggtattcttccaatactgaaggttgacaaagggcttgcagccgaggcggacggagtgcgcctaatgaagccgatcaatgggctggatgctctccttgatcgggcaaaggagcgccacatattcggaacgaagatgcgttccgttatcagcagttataatgagaagggaatccatgagattgtcaagcagcagttcgcctacggcgtccagatagcaaaggcgggattcgtgccgattctggagccagaggtagacatccacagccaggagaaggggaggatcgagtcgttcttgaaagcggagatggataggcatctggccgatctggatgatggaatccggattatgttcaaactgacgcttcccgatgaagccggcctgtacgacagcattgcttcagacgcccatgtagtccgggtggtcgcgctttccggcgggtacagccgtgaggaagccaatgagaagcttgcacagaaccaccatatgattgccagtttctccagagcgctgacggagggacttgctgactcccagacggatgacgagttcaacgagatgctgaaggaatccatccaggcaatctatgatgcgtccatagcataggaaaagcatcttgcaagggcaaggcctgtatagtataattaacgaaggaacaacaggggtgctcgcgtaagcgggctgagagtaagctgtatcgctttaacccataacctgatttggataatgccaacgtagggagatataggagtaaagagtgggattttactgctgtaatgctatctgcgttacagcagttttttgcgttatgcgtaagatttcctgcagaatctcttctgccagcattcatccatctgtcattcaagaacaaaacgaaaggatggaaaaagaatgagaaattatgcaacacagatggaggcggcacgaaaaggaatcgtgaccaaggaactggagacggtagcgaaaaaggagcggatgacggtggaggaattgatgcctctggtagcgtccgggaaagtggcgatctgcgccaacaaaattcacgcctgtatcagcccggagggtataggctccatgctgaagactaaaatcaatgtgaacttaggcgtttccagagactgcaaggattataatgtggagatggagaaggtcatggaggcggtccgcatgggagcccatgcgattatggatctgtcttcccatggggatacggtaccgttcaggcgcaagcttacccacgagtgtccggctatgattggcacggttccggtgtacgattccgtcattcattaccagagggatctggacacgctgactgccagggattttatagacgtgatccggctgcacgcgcaagacggcgtggactttgtgactttgcactgcggaatcaccagaaagaccatcgagcaggtgaagaagcataagcgtaagatgaacatcgtatcccggggcggctccctcgtatttgcgtggatgtgcatgaccggggaagagaatccattctacgagtattatgatgagattctggatatctgccgtgaatacgatgtgaccatatctctgggggatgcatgccggcccggatgccttgcagacgctacggatgtgtgccagatcgaggaactggtgcggctgggagaattgacgaagcgcgcgtgggaaaaggatgtccaggttatggtggaagggccggggcatatgcccatggatcagattgccgcgaatatgaaggtacagcagtccatctgccagggtgcccccttctatgtgctgggccctctggtgacggacattgcgccgggctatgaccatatcacttccgcgatcgggggagccatcgccgccgcttccggcgctgcgttcctgtgctacgtaacgccggcagagcacctggcccttcccaatgtagaggatgtaaagcaggggatcatcgcctccaagattgcggcccatgcggcagatatcgcaaaaggcgtaaggggcgcaagagaaatcgatgaccagatggcggacgcgagaaaagcccttgactgggaggcgcagtgggcctgctccattgacccggagacggccaaaagaatccgggaagagcgcaagccggagcatgaagatacttgttccatgtgcggaaagttctgtgcggtgcgcagcatgaataaggcgctggcaggagaacatatagacattttgtaagatatatggattctgccaagggggacatgtgataaatgactgttcattcgggggtgaagatgctatactaaggactataatccacgggaaaatatcgtcattagagcgggaggtatcatatgggagaattatcgaaactgccgaatatcggcccaaaggtagaggaacagcttcagggagtaggaatcacgacttatgagcagttgaaagagatggggagccagcaggcgtggcttaagatcaaggcgattgatgattccacctgaatgcaccgcctgctcgcgctggaaggcgcaatccaaggcatcagaaaaagtgaattgtctgcagagaagagagcggaactaaaggagttctataatgcagccaagtaattttctggaactaaggcttctccacgaagattcgggggaatggggccgccagatgaggcttctgaccctgaatccaatcctgtatctggagcaatatgaggagatcgcggatgaattatacaggtggaagcaggatgaggaattacggccgttcattgacagagaagatatggcagtcgtccgagaatccataatatattatgaagaagatacaaaacgagaattgcttccgcccggactgtgcgtagggatcgggacatataagacggtccgggacggcgaactctatatgtgcgcgctgatcgaccggggcagccgcaaggttatggcgtattctttcggggtataccgcagcgcagaactggtgggaaaggccctggaaaatgtagaggtgctatacaggctgtcgggtaaggccagccttcttagcagccggaatcctctgtatcggagccggaagtaccagaagatgctggagggcttacggatagagcaggagatgacgcaaaagggcacaaggggcggcgcggcgatagtcagcacctatttctcctggcttatgcggcgaaaaggccatacggtatttcagacatggcaggatgctattgactggcttacgatggatatcctgcggtataatcttaatttgtcctgattaggccgccaacttgacgttccgatcgaaaaaagatagtatgtaatcagcaaagataaaaacacaacgtatgcttatgcatacagtccggttggtagtccgggcgcggcactgtgctatttgcgcgggctgtcagtaaccttcctccttaggtcgtccattcttttgcttatgttttcattaaggaggaaaagaacatggacaaagtattggtaacactgacggtattttttgaagatcctttttgggtcggcgtggtggagaggatcgcagaaggaagcctttcggcttcgaagattacattcggagcagagccgaaggattatgagatctgggatatcctgctacgcggttatgacaggttacgctttagtccggctgttgaaacggctgtaaaagaggcgaaagtgaatccaaagcgcaggcagaaagaggcccgcaggcagacggaggccgccgggatcggaacaaaatcccagcaggcgctgaaattacagttggaagagaggaagacggagcgcaaaagcagaagccgggagttaagagaggcggagcagttgcgcaagtttgaattgaggcagcagaagaaaaaggagaagcacaggggccactaggctcccgtgcttttgctggttcagaagtactaaaggagacgaaagatgcgcattattatatcaccggcaaagaaaatgaatgtcaatacagatgtattcccctgccaggaactcccggcttttcttgacaagacccaggaattgttagattatatgcagtcattggattatagtcaatgcaagacgatctggaaatgcaatgacaagatcgcggaattgaattaccggcgttttagcaagatgaatttggaaaaatcgttgacgccagccatcctgtcttacgaaggcatccagtatcagtatatggctccggcggttctggaggaagaggcatttgcctatcttcaggagcaccttcgcatactatccggattctatggaatcttaaagccgtttgacggcgtcgtgccctaccggctggagatgcaggccaagatggggaatcatagacagcgcccttctcttggctcactgtatgaattctggggcagcgcactggcagacgcgttatttgaagaggatccattcattctgaatctagcctcaaaggaatacagcaaatgcatatccagatatctgcggcaggatatccggtttattacctgtgtctttgcagagctgatcggtgataaggtggttgagaagggaacactggcgaagatggcccgtggagagatggtccgctatctggcaaagaaccaggtagaagacatggaaggaatcaagggattcagccagttgggctaccatttttcacagaaatattctgatgcggatacgctggtgtttctaaaggaatcataacggtgggtcaaatcatgaaaaggtttgccgccaaataaggcagatagaagatgagaaaaaattatggatatgcatacagatacgataaatagaaaacaggacatgcatcactctatagagagtctcatgtcctgttgctttagactataaacggagtgcattgccgaagttggttcagtctgttttaaagaagactttctttcttttccagaatcgcggctacggctacgcaggccgggcagtcgcagtatttggctccggcagccttgatctctttggcatgtgccgcaatattcttggcagcgtccgcgccaaagcactgacttccaccttcggattctgcaaaactgatcaaggtgtcgatcggcatgatatctgcctccagctcgtcaatatacttcttcgtttccgcagcttcggcatctgtcccaagtgcatccagccaggccttagccgcttctctggcttcgctgctgcatgttggcgcgtcgatcaattcgtgtgtcttttcaactacataatctaatacttctttgttcatattgacatgccttctttctttttttatttatccctattctaccataattgtaagaaagcggcaaatcgtatcttgccttgacgggtgatcgtttagtccaaagattcatagatggcgtcaagcccggtgatcccatactcattcaggaggcttcggatgccctcctggatctcggcccgggagtagtcggctgcagtcaggaaatcatccgagtattcattgatgtgggaatagaaggcaaggcccagcatcagatattccttatcctcagggtcaagatcttcgtacatcatattttccgcgctgttgatccttccggcatctgcaagggcgatgagacgggcaaagttatcattgccggtcatgttgcctgtgaaattagcaaagtcatactgaaactgctgcctgccggtgatcagctgcatcaggaaccgtacgacatcctgaatcatacgcataatataatcttgctcaaaatccatagaatcacctcaatccttgcttattcatcttcatcttcatattcctgatccagcttcgcctgctttttcttcgtatattccccaatagccgcaagggtcgcgaacatcaggataaagatggagattgcaaaaatcagggctgcatagccagcgtgcgggatgtcccggtatataagggaagccaggaacatcaggccgaatattagggttcctatcaggcttgacagcagatagttcttaagaccgggcttagagctatagttccataatcctctcttcatacatccggccaggattgtgacgcagcctgccagaaaggcgacattttccccgatcaacgctctaaaaggtacctggaaaaataatgtcttagccgaaatatcggccgcaagggcaaaaaacaacacgtagaagcctgcccgttctatttttaataattctaattcctgccgttcatcaactattttcttcatattcatcctcctcccagaatagttcgtctaatgttacatgcagaactttgcagatggcaatgcataattttagtgatggattgaatttccccgcctctatcatgccgattgtctgacgtgttacgtctactttggcggcaagcatctcttgggacatatcgaggcttaggcgggccatcttcatttttttattcttcatcctttcccgtgcctcctcttgactatagaataatcggtttttcaaagaatgtcaactatattttacatattggtgaatatattttgcaatagtacattaagggaaaaagaggtataatagaaattaatctacttaaagaaagaaggaaaatattatgaagaagagaaggctggccgcatggctgatggtgctgtgcctttgtacggcagcgcttgcgggatgcagcgcaaaggaagaggacaagaaggcagatacggccaaagaagagcaggccaagaaagatgataaagcaaaatcccagactccgatcaaggtaggggcgcttaaggggccaacggctatgggaatggcgcagatgctggacgatgaccagtatgagttcacgatctcggcatctccggatgagatcgtgccgatgatagtccagggacaagtggatattgccgcggttccagcgaatctggcagccgtcctgtaccagaagacgcagaagcaggtgaacgtgctggcagtcaatacattaggcattctctatctggtggaaaatgggaatagcatccagtcggtggaagacttgaagggaaagacgatctatgcaagtggaaaaggggcgacgccggagtacgctcttaactccgtgcttaccgcgcatggcatcgatcctctaagcgacgtaaccattgagtacaagtccgagcatgcggaggtagttgcggctctggcggcagacccgacggcagtaggtcttttgccccagccttttgtgactacggcgctgatgaagaacgaccagctaagggttgctctggatctgaatgaactgtgggaaagcggaacggcagatggaagccgcctggtgacaggcgttgcggtcgttcgcaaggaattcctggaaaagcatcccaaggaagtggaggcatttatggaggcctacaaaaagtcggtggattttgtcaatgaagatacgcaggcggctgctgagatcatcggaaaccatgatatcatagccaaagaagtagcagtaaaggcaattccggagtgcagcatcgtattcgtggaaggcaaagagatgaagaccatgctctccggatatctgaataccttgctagagcagaatccggagaccgtcggaggtgcagtaccggatgatgacttctattatgcaagataagaagaacatacattccagaagttccaggataaccatccgcattctggcggtggctttctggctgctggtttggcagattggcagcatgtggctgggccaggagattctcctggcctcgcctgtatccgtggcccggaaactatccgaactgctggtgacgcaggaattctggaaatctgtctggttcagttttggaaggattataggaggattcctaagcgctctggcgatcggggcccttctggcaatcctgtcctatcgctttgagacggtgaagattctgtttcatccgctggtaaccgctgtgaaatctacgccggtagcatcgttcatcatcttatgcctgatatggattccctccaggaatctggcggtatttatctcgttcctgatcgtctttcctgtgatttatgcaaatctgctggaaggactccagaggacagacgaacagctgctggaaatggccgatgtattttccatagggaagggaaagcgggcgctgtatatctatctgccgcaggcactgccttatctgctgactgcctgcagccttggcctcggactttgctggaaggccgggacggcggcggaagtgatcggcgtgccggaaggctctattggagagaaactctatcacgccaagatctacctgaatacgccggacctgtttgcctggaccctggtaatcattacgatcagtttcttgtttgaaaaatgcttcctgtggggactaggcagaatcatccagtggatagaaaggacatagaaggatggatattattgtagacaatgtaagcaagtcctacggagaccaggcagttcttaagaaactggctttttgtttcccggaggggagaatctcctgcatcatgggcccatccgggtgcggaaagactacgcttatgcggattcttcttggattagaaggtgcggatgaaggacgggtagaaggcgttccttacggaaagataagcgccgtatttcaagaagacaggctatgcgagaatgtaagcgccatccggaacctgaagcttgtgtcagacaaaggcgaagcagaactacgccgcgagatggaggcgctgtggcttggggaggcatttggaaagcccgtgcgggaactgagcggagggatgaagcgcagggtcgcgatcctgcgggcacttctggcaccgtgcgcctgcatcatgatggatgagccgttaaagggactggatgaagagacgaagatcgttacggctgattatatccgtaagaacgcaaaagaaaagaccctgatcgtcattacgcatgacaggcaggatctggaacttctgggggcagataaactattgacccttgcataggctaagggcggatgccttccgcttccaccaccttgatgccaagaaaacttttcaggcgcagcctgataatgtcctcatagatgagggccggggagagaatcaggagttcgcccgcctctccggggatgatgcggacgacttttctgtgttctttcaggctcttggagagcctctggtcagcaaaccttgctgagatttccagacggcctgttcaagactgcccggcgtaggactcaattacaatcgcgcagaatcccttcttgtccatatagtcttttaacttctgttcatagatgatctgcattttcattcctccgtatatgagataatggtgtccctgatactgtatggttagatattatacagtccgcttgagggaaatacaataaaacttgggaaaatatgagattttgtaacccggtcacagaagatccctttggattgcgttatgataatgccaacaaatcaaaccaagcaacgaaatcaggagggatcactatgaaggcagtaatagataaaaaattaagagattacatggaaaataagaaattaaagaatatcgttttattcaaagaaacgtgcaacacctgaggcggctcctacgaggatatagcagcaaggtttgctgatgaggaagaaaaagaggagttaaaggcaagcgggtttaaaagcattccgacggaaacgggcgaactgttcgtgccggaaagaggcatctcggtatccgagaatatcaagctggggcttgtgaagtttctatggggcacaagaatcactatcaagggagtagcggtacaataggatatctgcataaaggactgccggggtcacgtatgactgccggcagttttttgatcaaatgatccaagcaaatttacgtatacacggggatgtaaaaggggctataataagcccatagaaaggaggcaatattatggacgattataaatggaaaacagctgtcattaccttaagcgacaagggctacaggggagaaagagaggataaaagcggtccgctgatctgcgagatgctgccggaagattcctacagtatcgaggagaggctgctgctcccggatgagcaggagatgatcgagaaggaactgatccgtctgtgcgacgatgcccatatggatctgatactcaccacaggggggaccggattttcccagcgggactgtacgccggaggccaccttgcatgtggctacgagaaatgcgcagggaatcgccgatgccatgcgctactgctcccttcaagtcactccgcgcgccatgctaagccggggcgtatcggtgatccggggaaagacgctgatcatcaatcttccgggcagcacgaaggctgtcagggaaaatctctcattcatcctgtcctccttggagcacgggcttggcatccttacaggaagggatggagaatgcggaggtgcatagaatgaatgcaggaagaataagcaggattcaagtatttgaagcgaagaatatgccgggaaggcaggaagccgctgtgcgtgtcgtcagaaacggcgggatcgaaggagaccggcattgtatggatcaggaaaagcagatcagcattatgtgggaagatgccagccgctttgtagaagaggaagagataaaaggactgtgcttttccaggattaaggcgaatctgatgatcgagggccggatgaggcttgaagtcggagacaagatccgcgtaggcagcgccctgcttctgattactgataggaaaggcgcttgctttgacgagtgcgggcggtacaagacagggatggattgtatgctgaaggactgctgctggtttgccacagcgcttgaggacggggagatccgtgcaggcgacttgctgacaaagccaggtagcctggaatatgactggcagcgctatgaaaggcagatgatggttccggggatgggaagagaggcccaggagaggcttgagcaggcatccgttctggtggtgggggccggcgggcttggatgcccggtattgaccgcgttggcagaggctggcgtggggcggatcggaatcatggacggggacgtggtagaacggtcgaatctaaaccggcagtatctgtataccccttccgatatcggaaagaggaaggcggtctgcgccggagcatggcttcagcggttccggccggatatcgagcttgagatatgggaggaacggctgacccgggagaatgggaaaagaatcgtatcatcgtttgatttggttatctgcgcggtggataaggtcaagacccgcctgctgatcaaccggctggcaaaagaagccggaaagcccctgatcgacggagccatagacgggcactatggaacggtgaccgccgtgaccggaaggcaggatccctgcctggcctgcatgaatccggaggggaaagaaccggaacatataagcagttccctgggaaccactacgatgattgtcggagcgttggaggcccagcttgcggtggcgtatctggctggtcaagagcgaaaaggaggcagcgtgctaagctacgatggaatctatggaaccgtggaggaaattccggtatttaagaatccctcatgtccgatatgtggagaagatgactgttaaattgacaaattattaacgtaattggacgtgctgatgaaataattaatgataatttatggaaatttgtggtattatcagtcactttatattataatgagtactagaacaagtaaataaactccgagtcccggatttctgacgtatggatgccgataagcatacgggaaggcgggaccaatgggtagcgcgggtaacggcgctgcctgcctgattgcgaaggagtccattattatgcggggcgtgataatggatttttctatgtagagaaggaggtattggctaatgggtaagcagttattaattaagcccgaaaaatgcctgggatgcagaacctgcgaactggtctgctctttcgggcacaatggagcattcaatccaagatttgccaacgtcagcgtaatggcctatgaggaggcagccatcagcgtgccgatgatgtgcatgcagtgcgaagagccctgctgcatggaggtctgtccggtaggcgctatattcagggacgagaaggatgctgttattatcaatccggataagtgtatcggatgcaagatgtgcatgaatgcatgtcctctcggcaatatcgggtttaatacagagagaaggcaggtacataagtgcgatttgtgcggcggagaccccaaatgtgccaagttctgtccgacaggagccatctcttatgaggatccggaagagggaatcgacagaaagcgtgcgattgccgaccactttaaagatgtgtttggagaggaggcaaaagcatgatgtatggatatatgggacagattatcagagtaaatctatcgaacggcagtataacaaaagaaccgctgaatatgaagtccgcacaggattttgtaggtgcaagagggctgggaacgaaatatttctgcgacgaggtggatccgcagacagacccgcttggaccagacaacaaactgatatttatgacgggcccgcttaccggaaccgcggcatcctgcagcggccgtttcgaggtcgtagcgaaagcgccgcttaccggaaccataggcgctgccaattccggcggacattttgggccagaactgaagtatgcaggctatgacggcatcatctttgaaggcgtaagcgatcatccggtctatctgtatatcaatgacgatacggtagagttaagagatgcgcaggaactgtggggaaagacggtatatgatacgacagacgaactgaataaggcctgcggatcttccttccggatctcctgtatcgggcctacaggcgagaacctgtgcctgtacgcgggcgttatgaacgacaagcaccgtgcggcaggaagaggcggcatgggagcggttatgggaagcaagaagcttaaggcagtggcggtaaaggggacgaagtccatctacgttgcaaggccggaaggcttcatggatgccattgaaaacgccaggaaggtactgaaagcacatccggttaccggcgaaggcctgggcgcatatggaacggagatcctggtcaacattatcaatgagtcgggagcgctgccgctgcgcaatgggcgtgacggttccttgtatgcggatgcggataacatatccggcgagacgctggcagaaaaatatctggttcgaaacaaaggatgctttggatgctgtatcggatgcgggcgtatcgtagacatcccggatggaccgttcaagtccaggggagagggccccgagtatgaggcaggctggtcctttggcgcggactgcggcatcgatgatctggaggcagtgtgcaaggccaacttcatctgcaatgaatatggattcgatccgatcacgcttggctccaccattgcctgcgcgatggaattgttcgaggcaggatacctcacagaagaggacactggcggcatcccgattcggttcggggatgccgcgacgatggtaagactggcggaaatgacaggaaagaatgaaggattcggcgcacaactggctatgggctcttaccggctggcagaaagatatggccatccagaactttccatgtccgtaaagaaacaggagatgccggcctatgacggacgcgcgatgcagggaatcggccttgaatatgctacttccaaccgtggcggctgccatgtgcgtggctatatgacgtccccggaagtcctggggcttccggttaagatggatccgctggtaacagaaggaaaggcctctatgctgaaggtattccaggatcttaccgcgctgatcgattctgtaggaatctgcctgttcacctcatttgccatcggactgccagaagtagcggcgcagtaccgggaggcagtaggaagcgatgaatcggatgcggatatcctgctgaagggcgagcgtgtctggaaccttgagaagaagttcaacatcgctgccggcgtggagaaggataccctgccgccgaggctccttagggagcatctgccggaagggcctgccaagggcaaggtgaatgacctctataccatgctggcagagtattatcaggttagaggatgggatgcagaaggcgttccgacaccagataaagaaaaggaattaggattatagaacggaatcatgaatcataaattgcggcagggcagcgcccctgccgcaggcaaaaggagatgaagcaatgcagatcaagttttttgcttatctcagagattataccggctgcaagacgacggatttcccctatgaggaagatctctatcatctggcgcattccttatgcgacgtttacggggataggctgaggaaaaagatgcttacgccggatggggaagatctgggagaagagatcattattctgattaatggaaggcatgtggcacatctgggaggcatccatgcgaagcttcttcccggcgatgtggtgtcgatctttccggtcgtggcaggcggttaaaggtggtggaattgttggaagtttccaaagaaagtattgagaggatcattcattcctatgaatgcagccagagatacgcattggctatcatgcaggatatgcagaggacttaccagtatgtgccaagggaaggattagaggctcttgccggatatcttgggtgtccggtatcggcgctgtacgccatggcgacgttttacaaggcattgagcctggtaccaaaaggcgagcatatcatcaaatgctgcgatggcacggcgtgccatatccgcggcgcatctacgctgattgacgggatagagagagaactgggcatcggacccggcgagacgacagaagacgggctgttttccttcgagacggtgaactgccttggctcctgcgcgctggcgccggtgctggtggtggatgatgtctattatggaaaagtgacgctggagaaactaagagagattatcgaggatgtccggaaaggtggtgctgcatagatggagaagcagattcttatatgctgtggtaccggatgccgggcaaatggcagcatgaaggttgccgaggcgctctcggaggcagcaaaggcaaaaggggccaaggcccaggtgattgcggaagttaagactaccggctgcaatggattctgcgaaaatgggccgatcgtgaaaattatgccggataatctggtatactataaagtaaagcctaaggacgcagaagagattatagagaagacggttctggggggagaagagatcaagcggctcatgtatcaggatgacagcggcgcgagggtacgctcccaggaagagaatccattctatgcccatcagcagaaggtggcattaagacatatcgggaagattgatcccgagaatatagaagactacttaaaagaaggcggatacgaggctcttaagaaggcggtatccatgacatcggacgaaatcatttccgaagtagagaagtcagggcttcggggaagaggcggagccggtttcccggcagggaggaaatggaggactgccgcttcttatgagaatttccccaaatatgtggcttgcaatggagacgagggagacccgggcgcattcatggaccgctcgattctggaaggcgatccccactgcgtcatagaaggactggccatcgccgcggtagcggtaggagccgaggaaggcttcttctatatccgggatgagtacgacctggcagtgcggcatgtaaagaaagccatcgaggatgcaaaggccagaggcattatcggcgaatccgtgatgggctcgccccacaggctggaactttcggtagtcagaggcggcggcgcgttcgtatgcggcgagtccacggcgttgatggcatcaatagaaggacgggtgggagagccccgggctaagtatatccgttccgtgcaaagaggcctgtggaaccagcctaccgtgcttaacaatgtggaaacgctggctaatataccggtgatcattaagaaaggcggggaggcctttgcagatattggaacagaaggcagcagcgggacgaaggtctttgccctggtaggaaaggtaaaaaggaccggtcttgtggaagtgccaatgggcacgaccctgcgccacctgatctatgatatcggcggaggcatcctgaataaccgggcgttcaaggctgtacagacgggagggccgtcaggaggctgtattccggaatccatgctggatctggaagtggactttgattcgctggcgaagtacggagccatgatgggctccggcggtatgattgttatggatgacagaagctgcatggtggaggtggccagatactacaccaacttcctgtgcgaggaaagctgcggaaaatgtacgccttgccgcgagggcttaaggcggatgctggagatccttacggatatctgcgagggcaggggaagagaaggagatattgaactgctggaacgcctggggcgggctatgcaggacgcgtccctttgcagcctcggaaagacggcagccaatccggtgctgacaacgatccagtatttccgggaagaatacgaggcgcatatccgcgagaagagatgtccggcgggcgtatgcaaggaactgaccaggttcgccatacagccagagaaatgtattggctgcgatatgtgcgccagagggtgcccggcgaatgcgatcagcggcggcaagaaggaaatacatgccattgaccaggagaaatgtatcgcctgcggaagctgcagggaagcgtgcaagtttgacgcggtcattaccctgggaagaaatgatgccgcggaaagggggcagcaggcatgatagagattacgatcaacggaaaagcatgtacctgcgaaaagggagagttcctgcttgaagtagccagaaggaatggcttttacataccgaccttatgccatcatcctggcgtagcggaacaaggatgctgccgggtgtgcctggtagaagtggtggaaaacaaaagaagcaagatcgtggtatcctgcgtatacccggtggagcggccctgcgaggtgtatacggacagcgcccgggtcagggaagaccggggagcagtcctgatgcttctggcggcaagagccccggaaagcacggagatcaaactcctgtgcaagcagtatggagccatggatggcagccgttttgccccgatagaaggggagaagtgcatcatgtgcggactatgtgccagggcgtgcgcaagccttggaacaggagccatctctaccgtcatgcgcggaacttccaagaagatatccacgccttacgacgagcctagcagcgcgtgtatcggctgcttaagctgcgcaaagatctgtcccaccagagccattgattttgcggaagatgagaagacacgaagcatctggggacgggagtttgaactgatccactgtaaggaatgcggcgcggccgtaggaacaaaagaagagatggactatgcggcaatgcgctgcggcgaagaaccgacgtatctctgcccggactgcaggaagaagaagatggcagacgtgatggcgcacgcttatggcgcggaatagactaaaacagaaaatgacgcttgaaagaaggaacgcaatgtgaaagaccagtatggaagaaccatagattatatccgaatatcggtgacggaccgctgcaatctaagatgtgtctactgcatgcccgaggaaggcgtagagcaggtggcgcatgaagagatcctgacctatcaggagatcgtaagaattgccgggctgtgcgcccgaatggggatatcgaaagtaaaattgaccggcggagagccgctggtacgcaagggcctctatagcctcgtaagagaactgaagagatgcgaaggcatcgagcaggtgacgctgacgaccaatggcgtagaattaaaaagccagatggaggaacttgccaaagcagggctggatgctgtcaatatcagcctggatacgctggacgctatcatgtatgcctcggtcacgcgccgggatatgcttgataaggccctggagggacttaaggaagcgcttcggtatccgcaggtcaaggtcaagatcaactgcgttcctatgagaaatgtcaatgaaggacagtggacggcactggcagggctctccagggatctgccggtggacgtgcgcttcattgagatgatgcctatagggctgggaaaagagttccatgggaggagccaggatgatatccttgaggcgcttagaaaagcctatgggcaggagaccctcttttacgggaaatgtggaaatggtccgagcgtttacgtaaaatttccgggatttaaaggaaggataggattcatcagcgccatatcccataagttctgcggggaatgcaaccgtatccggcttacctcggaaggcttcttaaagccctgcctccagtatgaaagtggaacggatataaagggaccgctgcggcgcgggcaatcagatgaagaactagccatgcttatagaggatgctatatacagaaaacccagaagccaccatttcgaacaggcagaaggggaaggatttgaacaaaggcagatgtcaaagattggaggatgataacggtgggaaaagtaatagcggtctgcacaagcccggccaagggaacgcagaagacaagcgtagaacaggcagtgttcatcgaagattatggaatcgagggcgatgcccatgcaggcaaatggcaccggcaggttagcctgttatcctatgataagatcgaggaatttaggaagaagggcgcccaggtggcagatggggctttcggagagaacctggtagtggaagggattgattttaaaacgttgccgattggcacgatctttcaatgtaatgatgtcatcttggaactgacgcagattgggaaggaatgccaccatggatgcgagatattccagaaaatgggcgattgtatcatgcccagggaaggcgtattcgcaaaagtaatcaaaggaggtgtgattaaagccggcgacattttaaagatagtaaccaattaaaaattacatatcaattgcaggaattcgagcctggctgtctaaagtagcaaaagatgccatgacagcaggccaatgggtgctttttgaaaagagggcgccttccatatttgaaaagaatatccgcagacatcgataggtgtattttgcgtggtcttctttttcagaggccatttttttaatgggagcgtggcaatagaatgtaatggtacatgctgaaaaggaggaagaattgtatgaaaaagaaggttttggcagtgatgcttgtagctgcaatgtgtctggggcttgcggcctgcgcgagcaaagaagagcccaagaaagaggagccaaaaaaagaggcagaatccaaggactcggtgaaggataaagggaagcttatgatggcgaccacgaccagcacggaggatacgggacttctggactatctgaagccgctgtttaaagaggacacgggatgggatctggaatggaatgccgtaggtaccggagaagccttgaagatgggagagaatggggacgtggacgttgtacttgtccatgcaaaggccagcgaagaagaatttattgcaaacggctatggcgtggagagatttccagtcatgtataatgatttcgtagtgattggcccgaaagagcctatcgccaagacagaagacatcaatgccgtattcacgcagatcatcaatgaccagcttccattcgtatccagaggcgatgactcaggtacggataagaaggagaagaagatatggagcgagctagggctagaccctgcttcagatccgaactacgtagagtccggacagggaatgggcgcgaccattaccatggcggacgagcagaaggcttactgcctgacggacagaggaacctggcttaagcagagcaaggacgcgacgcttgaaagcgagcttgagattatctgcgaaggagacaagaacctgctgaaccagtatggggtgatcgccgttaatccggagaagtatccggaattgaataatgaaggagccaatgatttcatcgagtggatatgctctgacaaaatacagaaactgattggggaatatggaatcgacgagtacgggcaggcattatttacgccgaatgcaggcacggattcatagacaggaggaattagcagatggtagagtggttaaaaagcgtgatatcagatccgggaattatcagcgccatcaaagtgacatttacgatggcggtctgttctaccgcgatatcatctgtgctggggatcgtgctggggcttctccttgagaggttccagtttcccggaaagaagattgtcgtccggatcaaccggacgctgatgggagtgccgccggtggtcgtgggcctggtggtctatctcctgataatgcgcagggggcctttgggccctttgtcgcttctatttaccatcaaggggatggtgatcgcgcagacgctgatcattacccccatcatatgcgggatgatctattcctatgcaaggaagacggcgccttcgatcagagtattcgcggtgactatgggggcggacagatggcagacggcgaaactgacggtgcgggagatgaaaaaggaaatctatttctgcatggttaccggattcgggcgctccatcagcgaggtgggggcagtcatgctggtgggcggcaatatcaagggcaggacgcgcacgatgacgacgacgatctcgctgctaaagagccagggcatattcacggaaggagtggcgcttggagtcctgcttctggtgatggcattcctattgcagtggatatgcgatatactccagaaagaggaggcggaggatgaaaattactaacttggaaaagacgattggaaacttccatctggaagttgatgatttatatatagagccgggaaagatccacgggatcgtgggtcctaacggatgcggcaagacggtgttccttaagatggtggccaaaatattgaagccggacggcgggagcatcgattatgaggggcttacgggccgggatatcacgatgatgtcccagaggccctatctgatggatgcatccgtctatcagaacctgatatacccgcttacgcttcgagggatcaggccggatgaggatgcggtagaccagatgcttgaaagagcagggcttttgagccagaagaagcagtacgcaaaatccctctccagcggggaacgccagaaactgtccttcctgcgggcgctgatcttccatcccaaactgattatggtggatgagacgctgtccaatctggacccggagagcgaggcgctatttgagggaatgatcgtggaggtgcagaaagaggcgccgattacctggatgatcgtaaatcatcagctggatcacatctatcagctctgcgaccagatccactatatggaaaaaggaaggtttgtgaaatcatgaaattgctgaatgtagacacattggaggaggcccgccggaaggtgataagagcgatggagggctcgccgcttagagtagaagaaaaggaacttttaacggcacaaggatacgtgctggcagaggacgtctgtgccagggagaatgtgcccttattccgaagatctacggtggacggctatgcagtccgggcagcggataccggaggcgcaggcgagagtattcccgcattcttaaggatcgtgggggaggtggagatgggccgtgcgccggagatggaagtcacgcccggaacctgcgtctatgttcctaccggcggcatgattccggaaggtgcagatggcgtcgtaatggtggagtactgcgaactgttctcggatacagaagcggcagtctacaagccggtgccagtaggagctaacattgtagaagccggggatgatatgaaggaaggacagaaagttctggaaaaagggacgaagattacgccccaggcaatcggagccctggcagcgcttggaatcaccagggttcgtacatactgtccgtggaagatcacggtgatatccacgggagatgaactggtggcgccccgggagacgccaaagccagggcaggtgcgggatatcaacacgtatgggatctatgcggcggccaggcggatgggctttgaggtggcggaatgcgcggtgctcaaagatgacaggaaactgcttctggagacggcgcgaaaaggaatggaacacagcgatatcgtagtgatctcgggaggaagctcccaggggaagaaggatgagaccaattccgtcatagacgagctggccagcgaaggcgcatttacccatgggctggcccttaagccgggcaagcctacgatcctgggatatgaccggcctacgcagaccctgcttgctggacttccgggacacccggcggcagccatgctggtatttaggctggtgattgggtggctgtggcgtgcgtcgacaggggagatggagccttatccccgaacggcagccatatctacgaaccttccggcagcgccgggcaaactgacctgccagctggtgcatcttgccagactagaagacggaagcctttcagccatcccgatatttggccgctccggacttatcagcacgctttccggggcggacggctatatactgattgaagagaataaggaagggctgaaaaagggagagcgggtatctgtatacgagatttgaaggaggagccatgggaaaacggaatctatacttaaaaaccataccagtggaggaggcgcaggcattataccaggatgcgctgaaggcaattgccgtcaggaggacggagaagataccggtagaagaatctttagggcggatgacggcaaaggcaatttacgccagatgctgctccccactgttcaatgcggctgccatggacggcattgccgtgatcgcgaaggagacagccggagcaacgcaggagaatccgctcaccctcgtcagagggaaggattatcagatcgtagatacaggagatccggtacatccgccctatgacgcggtgattatggcagaagacctgctggaagcggaggaagacgtggtacagatcatggaggcggccagcggctggcagcatgtgcgccctataggagaagatatcgtggcaggagaaatgctgctccccggcagccataagatacggccaatcgacattggcgtgcttctaagcggcggcatactggaagtcgaagtgataaagcgtcctagggtgggattgatccctacggggacggagatcatagagccggacaaagagccgggcgagggggatatcattgaatccaattcccgcatgttcgcggcgatgaccatcaattacggaggcatcccccgtcgatatgcgccggtggaggacgattatgacaagataaaggacgccataaaaaaagcccatgaagagaacgatatcgtggtggtgaatgccggatccagcgcggggacggaagattacactgtacatatcttacgggagatgggagaagtgctcgtccatggggtggcaatcaagccaggcaagccggtgatcctctccattgtggatggcaaaccggtgataggcctgccaggctatccggtttccgcatacatcgactttgaaaattttgtcaggcctgtgatggacaggatgtcaggagaatgccattacgccggacataccatcaaggcagtactttccaaacgtctggtgtcctcgcttaagcaccgggaatatgtgcgggtcaaggtaggaaaggtaggagacaaactgatcgcctccccattggcaagaggcgcgggggctgccatgagtttggtgcgggcggacggattctgcgtcattgaccagaacagcgaaggagtagaggcaggcgagacggtggaagtcgaactctatcgggacttagaagagattgagcacacggtggtatccatcggaagccatgacctgattttggactttctggcagacctgatgccgctatcttatccgggaaccttcctgtccagcacccatgtagggagcatggcaggactgatggcgctgaagcggggagagacgcatattgcgccgacccatctgctggatgaggagacgggggtatacaatgtctcctatctgaaaaaactattcccgggtaaacgtatggcgctgatcaaaggggtgaagcgtatccaggggattattgtccagaagggcaatcccaaaggaatccgcgggatcgaggacttgacgcgggttacgtatgtcaacaggcagcgaggcgccggtaccagggtattgctggattaccggctgaagacagccggaatccgtccagaggagattgacggctacgacaaggaagccgcgacccatatggcagtagcggccctggtgaaaaatggaggggcagacgcagggatgggaatctattcggcggctcgcgcaatggatctggacttcatacctgtgggagaagaagagtacgactttgctatagaacaggagtccctggaactagaggagattaaaaagttccttgaagtgctgaaaagcagcgcatttgcgcaaaaggcccgggaggccggaggctatgatatcagccatgccggggaagtggcgaggttataaaagaggttctaaaaatagtactagctttcttgtagaataaatggtataatacaaaaaggtttaaagacaagggagcaaaagacatgaaaaaaccatttacttttatcgacttattttccggtattggtggatttcatcaagcgatgagcagtttgggcggacagtgcgtgtttgcctctgagatagataaatattgtattgagacgtatcaggaaaattatggaatgaactcgggcattgatatacgcaatgtcgatgagaaggatatcccgccgcatgacgtgctgtgcgcgggattcccttgtcaggcgttcagcaaggcgggaaagcaggagggcctggaagacgagaccaggggcaccctgttctttgagatcgtgcggatcttgaagcatcatcatacgccttatatcgtgctggaaaatgtgaggaatctggtgtcccatgaccatggaaatacctggaaggtcattcgggcaaacttaagaaagcaaggctaccgcctgatggagaagccgttaatcctcagtccccaccactttggcgtgccacagcttcgggagagggtggtcatactgggaaagtacgagccggaccgcgtggacgagccgcttaatatcgctttccacgatctgatgaagaaggagcagaattcaatctacgacgtggtaaaggatcatcccgtggatgagaaatatgccatatcagagcatgaagagatggtgctgaatgcctgggacgaattctaccatggcattgatatgaaggtgatcggcttcccgatctggtccgagttcttccgctatgagaaggctcctgcagagttcccggcctggaagcaggagttcgtcaataagaacatccggctgtatcagagcaaccagaagttcattgaccagtggctgaagaaatataacgaccttaaggattttacgcctacccagcgcaagatggaatggcaggcaggaaccaatattaacagcgtatgggaaggggtcatccaattgcgcccctccggcgtcaggatcaaggtgcctacctgttttccagccctggtggccatcgtgcagattccgatcatcggcagatacaagagaaggcttacagtggaagaatcagcggctctgcaaagttttcctgcgaagttcatctccaatgccaatgaccagcaggcttataagcagtatggcaacagcgtgaacgtgacggtgatcgcagaatgcgcgaagcggctgtttgatctatagaaaagttaaattatgacgtcgcagatagaaaacttgttgatcatatcatggtcgatcataatcttcggctcccgcagcttgccattgctgttgacgccctggcggaacatgctgaggaagtgcttattggagttattgatgtccaggatatgcatcttggatagcaccacatgatgcttcatccgcttctgatagctcataagattggatttgccctgtgcgcggttccagaactgggtagtctcgtatccgtgctcgctgtccttgtaagtggcatgctcgcagataatgtagtaaatgtggtgctcataatcggtctggcccagaatgccgaatatggtgttccagtcgttcccctggatgcccttggaataattgctgtgggccttaaggtcgccgtaatccataagcgtgggaaagtacaggtccagatcgatgccgttcttcttcttgttctgttcgtagcggatcagatgctcaagcgaattctctttcagatacttttcgaatcggtactccagatagaatccggcccattccggctgatacttattccggtagttgtcggcgatcatttccttatagcagtcgatgccgtcccagcggctgggcagcccaaggaagaaatcccggaagatatccacaatctcatccggcatcgccccaggaaaggctggcgctgttccggagacgggggatggcaggcctgtgaaataatccaggatgtcaaacgctgaatcctcgtctgcgctggcctcctgcaattcggcttccaggccgaacttctctgataggaaggcttcgacgcagtccgggcgaaatacggttatgtgattgccacggtagtctgtcttttggaagatgccgtcctccgccgcgaaggaaagatcctcggtatagacatgggcggaagaattgttagacttctttgcgacgaaatcctcaatgttaaagtcacaaaacagcgtcaagtcatcccgggtataaatgcccaaaagcagcggagtcattccccgtgaaagggaatcgttgtagaaatctttaagatctccggatatctggatccgttttttaaaaacagggtgggggatgccaagataggtgatgttcttcactcggatggagtaaaggcggtctttaaaattaccggttatcattcccttgtctttccggatgtccgggaaatatgttttcaagacttccaaaagatctttggccgacaggctgatgtccacgtccatgtatgtattgccatcatgatcgacctgttcaacgatggtatttcctctcataagcagtatctccttatcgtttaaatatttgtaatgcgcatattataaaaatatgtgccagggtgatgtcttctaaagatgattatacagtaaaatagaggagaataagcgggactttattgttttttaatgaaaaaaatgatacgttaatactgtattatacaaaagcagtgagagaagtgaagaggctgcttatcgaggagggtaatatggcaagatttgtaagagatttggtgataaaccagccggatgattttgttcattttataatgaatgactatctccagaagaatcagtttataatggcagactggaaaggcgagccggcataccgcgcgggagatgccatgctggaaggctataaatacctgaaatggttctattccaacggagcgcttcacttggaggcgtggataaaaggaacggccggaggcgaatgggacctcgacggattcgtgggatgtatggcgaagaagccttataaagagagcctggagcagctgttcgtgacgcttcagcagccggtgccgttgccacagggaatgcaaaatccgcagggagcacaagggatgccgaatccgcagccgataccggtacatacggtggacaacacaaaggcggccacaatggcgctgacgttcggcatattaagccttgtgttctgctggataccgatcgtcagcattatatttgcgtgccttggaatatcgagggcgagaatgggctcaggttccagtaaggccagccaggcaaagacgggcaggatactctgcatcgtgggactggtgcttgcgatcgtgctctggatcgccaatatagcgatactctacatatagcaagcaaaggcatctggcgtaaggcaggtgccttttgtgatagaaagcgcattctttactctaaagcagaattgggggtagaaaaatggatgttctcagcgagcagcaaagaagaaaaacgatgcagcatatcaaagggaaggacaccaagatagaagtccagctgcgaaaggcattgtgggccaaaggataccggtaccggaagaactatgacaaactgagcggcaggccggatattgttctgacgaagtataagattgccatcttctgcgacggcgaattcttccatggcaaggactgggagatattaaggcccaaacttgccatgggaaagaatccggattactggattcccaagattacaaggaaccggcagcgggatgaagaggtcaataaaaaactgctctttgagggatggacggtgatacggttctggggaaaggatatacagaagaatctggatgagtgcgtaaaagccattgaagaagtcatctttgaaatcaagatggagccggaggaaatcggctgggaagatatggaagatgagattgggaaatgaggcggctttgtggtatacttgatattacaaggcttaatccttctgtccgtctgtaacacctgcatggacaaagggaaaaagttcttgaataatataaaaaccagggagtgacgttcatggagaataggacggtccgcatatttgcggacagcacatgcgatttgacagaggacttgattcaaaagtatggaatcgccatactgcccctctgcatcgtactggatgataaaagttattatgacaggacccagattacgccggatgagatatttgcctgggcagaggcaaataaaaggacgccaaagacggcggctatcacctttgaatacgcagagaagatgcttagaccttgcatggaagcggatgaggatgtcatcttttttggcatttctgaagaaatgagtacaacctgcaatgttatgcgtctcgcggcgaaagaatatgataagggaagggtgttcgtgatagattcccagagcctgtccaccggaatcgggctgcaggtattgcgggccgccgagatggcaaggcagggaaagagagcggaggatatcgtgactgagattgagacggcgcgctccaaagtgaaggccagtttcgtggtggatacgctgacctacctcgccagaggcggaagatgctccggcgcaacggctctgttggcaaatacgctgaaactgcatccttgcatcaatgtaatcgatggcaggatggaagtcgggaagaaataccgtggcagcatgaataaggcattgctgcactatgtaagggaaaaggaagaagaacttaagaaggcggacggcacgcgggtattcatcacgcattcaggggcgtcacctgagattgtggagcagatccgggattatctggcatctctgggacatttccatgagatactggagacgaccgccggaggcgtcatctccagccattgcggcccgggaaccttgggcgtgctgtattacgcagagtaagcgaggcagtgataaggcggctgcaaattcctacttatcattttttatactgtctatttccaccagattatatttcttgacattggaagatatgacaagtacgcagaagacgcctcccaggagaatgaaaatattcggcagccctccaagattggacacaagtttgatcccatcaattccggaaattgtcagcatgacataagacaggacggcaaacattatgccccacattacctttaaaaatactggcgactcttgatccttaggcgatatgccagaagtagataatgcagcgatggaattagtggtagaatccatagcagtaatcatcgaaaacatcagcgccgcaaaaaataacagtattataaaggtagagccaggcatatcgcggaaaatggcatagattacgccttccgcccctttggtttcgaggatgtggatcagatcaagctttccagtaagctggtagtttattgcaagattggaaaaaacgccgcaccatacaatgttgaatagtatcggaatgccgaaattaatcttgattaaatcttttactttatagcccaccccgagacgtgcaaggaaacaggcggatatgggagcccagctcgcccagcttccggcatagaacacggtccagcttttggcccaggaatcttctgcatatgcgcccgtagtcagaagtttggaggaaagctgcgagaatgtgccgccaactgcttccactgtgccatcgatcataaacatggtagggccgataatgaataatacccccagtattgcaaaataaataataacatttatattggacagcagtttaattcctttctgtattccggagatggaagagataataaagcaaacagtgacaatggaaagaatgataagccaggcgccggatctgctttccattcctgttaattcccggagcgcgccgcccatgtttaaagtaccggtgcagatgacgcctaggatgccaagccccatggcaaacaggagaattgtatccagtatctgagtaaatttgctgttttcagtggtttttatgtgaagcctgtctgtaatgacgctcagttgagatgcaacagaaaaaggctttttcatattgaaaaaggcaaaggcaaacgcgataacaggaagcgtgtagagggagtaagggtgtatggaccaatgaagaaccatagtctccatagcaaatttagccgattgccatgtgttaggctccattcctgccgggggcgccgacatatggtatatcggctctgagattccccagaacagagcgcctgccgccattgcagtacacagtgtaatggtagcccagttctttttggaaagaatcggcttggcatcttttcctcccaggattacattgcctaggggagaaaagtatgcgatggcaactgcggcaagacagaggaagcttgtaagactgtaagtccacccaaaatgctccaacacccaagtattggcagtgtctgccatggcataaaatccatctttatccacaatgctgtatacgagcgagccaaaaaggaggataaaggcgggccagaatgcgatctttctgattttgcttgtttttttgatttttcccatcataacggatttcctttctttggtaaatattaaaaaacaacaaaagatgccccaaacccttttaaagtttgtggcatctttcttctactcaactgatgcattatcattaaattatttaaatattaacagatgatataagacatgtcaatgcagaagggccaaaacatgaatatgcaaagtatacaaaaataaatggggcgaattgtctaaataatcgaaaatctaaataaggattgacaaacaaaagcaaagctggtacgattggggcaaataaaataaatgtatcgttagaagcaaggaaagacgaacaggcatacttttagagtatgcttggttcgtctttttttattctctgcacagtgaatatacagagagggaagggccttcacgatacctaaattacgcgaatggaggatacaggtatgcatcaaatcaacgatttccacatgggattattttcactggaaggaaagaatgcggtagtgacaggaggaaactcaggactgggccaggcattttccacagccctggctaagggcggtgctaatgtaatggcagccagtatcgtagatgatgacggagagacgaggaaattaatcgaggaatgcggcaaagagtacaaatttatcaaagcagatatcacagcagatggagaatgtaaaagagtgatagatgaatgcgtgaacacatggggaagcattgatatcctgattaactgcgcagggctcagtattaatgtggaagatgtgacaaagtatacgagaaaagagtgggataagatggtggctgtgaatctgacggcagctttcgagatgacgcacgaagcatgcaaatacatgattcctcagaaaagcggcaagatcattaatattggctccttgtacaccttcctgggaggccagtggtcaccggcttatgcggcaaccaagcatggaatcgcaggtcttgcaaaagccatgtgtgatgagcttgcacagttcaatatccaggtaaatactatcgcgccgggatattttgccacgaaactaacagaaaagacaagaagcgatgccaagaggaatgcagaaattctggcacatattccagctaaccggtggggagacctttatgatttgatgggagcatgcgtttttctctgcagcagcgcgtcagattatgtaaatgggcacgtgctgacagtagatggcgggtttttgatgagataatgcaaaggaagaaggaaagggacaggtgaaagactttggaaaaagggaaaaagagaaacaagtgggttacttttatgattatctgtatgacatgcggaattattacagagctgccatatcttaggtgggcgctgtatgagccgcttagagaggcactgggacagaataatacgcagtttggcatgtctatgagtctgtttggattattggcagctatcctttacatacccggtggatggctggcagaccggatatcgcacagaaaattatttgcggcatcggcaacaggatgtggaatccttggaatctggctttccacgatgccatctttttcttcgacaatgataatccacggtttatgggcaattaccaatatcgggatgttctggcccgccatgactaaggctgtgtcgcttttggaagaaaaagaagggcaaggcaagatattcggattgtttgaaggagtcagaggagtgttcgtccttgttatgtggctgggactgatgcaggtatttgaacgtatgggaggcattcgcgccgttatactcgcattggccatcctctctatcatctgcggagtggtaagcttcttctttatggcggacaataccgggcagggaacatcaagtgatacttccatagtaaaagatatgcttacggcacttaagaccccgtccgcatggctggtggctggcgtgatctttactatatatgccgcatattcctcatcctcttatatgcaggcttacggacagaatatattaggaatgtcggcggtggccgcgggatatgtcgggattttaagaaaagatgtaatacgtcttgtggctgcgcctttgagcggcttcatctctgaaaagataggagggaagtgtaccctcttgatcggaatatttgatattatttttattgcttcgctgatagcgctgcttggtattccggtgggagtagaatataccattattacggttgtgataatggtggtaagttcttttgccatctacggcatgcggggaatgtactatgcaattattggcgaaatcggaacgccaaagaagatatacggggcggtggccgggtttgccatgtttatcgggttccttccggacgcattcaactctacactgtgcgggcactggctggatgcatacgagggagcgctgggataccgttacatatttatctatatgctcttaaccattatcgtctgccttatactggtagggatattgcttcgctatataaagaagaataaaacgcagattgaggcaaatcaaaaagaaatgataaaggatgccgaaggaggaaatgcgtaaatgaaatacgtaattggaattgacgggggaacccagagcactaaagttgggatatatgatctggaaggccggattatatgcgaggaaaaggttatgctgcgtccgttgctcgtcccggatgcagacacggccgagcatccagaagatgatctgtgggattcattggtgacggcttgccagaggctaatgcggaagtttgaaggaagcaagaaagacattctgggaattgggcttggaagtatccggtgctgcagaacttatcttaagaaggatggaacgctggcatatccggttatcaactggatggataaacgccttgccaagccttatcagaacgatattaaagatatggcctatctgtccaccaccaccggctatctgacggtaaggatgaccggccaattcaaggatacagcggcaaattatgaaggggtctacggacctttcgacaagaaggaatggaagtggagcgacgatccccaggactataaagaatataacattacgagggagaatttgtttgatctggtgatgccaggcgacctcctgggatatgtgacaaaggaggcaagcgaagccacgctgctcccagaagggtgcccggtaattgccaccgccaatgataaggcggcggaaggacttggggcaggcctcagagatgatggctctgtgctggtgtcgctgggaacttacattggcggaatgatgagggggaaggcatatacagatacggcttctgaatattggtccaacctgtctgccattccgtatgaatatctttatgaaacaagcgtgggcatacgcaggggaatgtggagcgtatcctggttcaaggagcttcttggagaagcggcggaagaaaaggcaaaaagcatgggaaccagtgtagaagaacttctggaaagagaagcgaggcttatatcgcctgggagcgaaggactgataactgtaggcgaattcctggcgcccaataatatgccatacagaaaggcaatgttcatcggctttgatggacgacataagagggcccatatgtatcgctctattttagaagccatagcaatgacaatgaagatgagcgtggatgcgatgtgtgaagaacagggcataaagcctaggcaggtaatcgtgtcaggcggcggctccaacagtcctctgtttatgcagatatttgcggatgtattcggcatccgaagcgtgcgcaatgtaataaataatgcagcaggacttggggcggcaataaatgtggccgttggaacaggcgcatatccggattatgagacggctataggcaagatggtaagaattcgggacagtttcgagccggatctggagcatcgggaaatatatgaaaagattatcaacaatatataccgtgatatcaaagactattcggatccggtaaataaaaagatatatgaattattcggttagaaagcaatggaaagaggtaatgataatgagtttattaagggaagaaattgtagaagaattagttaagatttgtgggccggatcgggttgtgaccgacatagaggtactgcaggaaagttcttatgacaggttcaggaaatacgaaggctataataaagtatttaccaatccgctgcctgcggccgttgtatttgtgcaaaacaaaaaacaggtatcggaagtgttgagatttgccaatgccaatggaatcaacgtggtcccgcgtaccggccattcggccacggagggagggcttgagacaatcgtagaaaattctatcgtgctggatggctctcaaatgaagaagattattaatatagacacttacaacatgcaggtgacctgcgagtgcggagttgtacttgaagatttggaaaacaaggtaagggaacttggatttacaaccggtcattcgcctcagtctaagcctttggcacagatgggcggtctggttgcgacaagaagtatcggacagttctccactatgtatggtggaatcgaagatatgctggctggagtggaggcggtatttccggatggaaccatcacgaatattaaggcagttccaagaagagcggcggggccggatattcggcatatcgtgcttggaaatgaaggcgcgctgtgctttatcacggaagttacggtaaaactatttaaatattttccagagtatcatgtgtgcatgggctacacgctggatgatatgattactggcatccgtattatgcatgatgtgatgtctgagggatataagccttccgtggcaaggctttacgatgcagaagatggtaaggagcatttctcccactttgcagctgggaagtgtgtcatcctcttcgtgacagaggggccagaaagaatctctaaagcaaatgcagagggaatcaaggaaattgtaggaaaatatcccgaatgtatggaagttgatcacaaattgattgagacatggtttgcgaaccttaactgggatgctgcgcgtattgaagaagagcgcaaggaagtcctcgagacaaagaatgtatgctgcacaacggagatttctgcaaactggagcgcggtagaggagatctaccgtatatgcaaggaaagggttgtgaatgagatacccgatatcacggtattcggagcgcatgcctcccactgctactccaacggaattaatctttactttgtatactggtataatgtggtggactgcgcgccggaagatgagattaaaaagtaccatcttccaattaagaagattatatgcgaagagacgatcaaggctggaggctctatgtgccaccaccatggcgtaggcaagcacagggtacactggattgataaagagcatggctcagcgctttacatagtaaagaaattaaaagcggcatttgacccgaatggcgtaatgaatattggaacgattctgccttataaaaaatgatgaaacttctggtatgctttaaaattataccggatctggatcagatgtcggcgaaagattatgaggcggatgtaaggatgcaggtgaatacttcttatgtccgcaccatgtggaattgtttcgacgagagcgggctggaatttggattaagactttctgacgaggcggaaggtcttaatctgcatcttgagaaaacagcgtttacggtcgcgggagagcaggcagaactctaccttaagacattgaattcgcttaaatatgatgagacagtccgcatagatgataagggtcttgatatacgattcgtaccggaggcaattgcgcaggagattgctctttatgtaaaagaacatcctcaggattatatcatcatgggccggcaggcatcaccgggaaataacggactgacgccatactttacggcgtcagcccttggcatgcgtctggttcctgatgtagtggatattcatctgcttgagggaggcaggctccgggcagttacggaagaaggcggagctctttatgagcagattgtggataggcctgccgtattcagtattgggaatgcagtaattagcaaactcagagttccgactttaaaagatcgtattcaatatggaaagaaagaaataaaggtggcagaagcaaaagccctggacggatttgcaggtacgatacctattgcgctctcctatatcgacaggaagcgaaaaggggagagggtcaaggagaaaggaagaaaggccgcagaagaactgggaagattaataaatgagcacagacgtagttaaaggaagggaatattgcatatgaaatggttgtttgtaatatgcgcgccggatgacgtttcttatagaaaacaaaagaaacaatggaaaattatcaattccgcgcttatggatagttcaataagcataactgccgttgcctaccgggtggcctatacagaatctattgcacaggatatcttcgagcttgactattcggaaggatatgatggggtgctggtggcagcaggagattatacggaggacatagctggcagatatgccgcgcttaaagaatgcagatgtattcttgggatatctggcatcacacgggacgggaaagaagccctcttctataaatccgtgtatcaggctaatatggaagcggcttttcggctggagccgccatttgctttagggcttgcccagtggagagacagggaggttcctgcgtatagccagaatcaaatatttgaaaggattgtgccagagcattttaaagatggcgcagagaagactttgatagaagctggagagaaacagaaggaatcggatgttctgctggtagtgggaaaaggagtacgaagcaaggaagaagtgcaaaaaattaaggcatctgcaataagcagagggtacatgtttggagtcaccaggccggtagccatgaatggctgggcgctgatcgatgagatcgtgggagtatcaggacatatctactcgccggaggtttgtattactataggcgtatctggttcggccgccttttatgcggggattgaaaacagtggatttattgcgtctgtaaataatgatgaatgtgctccaatcattggaatgtcggacgtctttgtgattgatgattatgaaaacattttggaaagactttttcaggtgctgtgaggaacggagttatgaatagaatgtaaaaggaagactgaaccctggggaatatgatataatcgaaaatatagaggaaggaggcaggaaagatggtaaatacgactgcaagagcctggggatccccgtcaagatatatacaggggcctggggaactgatgcgattagcaatgcatacaaagaaatatggcaaaaagatttttgctgtgattgacgaatacttttttgaggattatggaagtaaattagagtccatgtatgaaaaggagggagccgaattacatagtttttgctatcatacagagattacaaaggagcgtattgatgaggcgcttgtaaaagcatgcgaagcaaaagcggaagttatagtaggaatcgggggcgggaaggccattgatacagctaagtgcgtagctgcaaagatggaagcgccgcttatcgtcataccgacaagcgcttctacggatgcgccgacaagtgcaatggcaataatctataatgacagacacgaacacgatgatgtctactattttacaaaaaatccggacatggtacttgtagacagcaaaattattgcgtcggctccggtccgctatcttgtggcaggtatgggggatgcgatggcaactgcgttcgaggcgcgtgcaaccattgctatggacagcaataattatatttgtcaggagagcggatgctatcggcggacaagaaccgcagaagttattgcgcaggagtgccttaagataattctggaaaacggccgcctggcaaaactggctaatgaaaagcatcttgtgacggaggcattggaggcagttattgaagcaaacacgttaatgagtggccttggcttcgagaatgtaggatgtgcggctgctcattgtatctgcaatggcatatctttggcgccgggagggaataaagcgctccatggagagaaggtggcatttggcgtcatatgccaacttcttgcagaacatgctccgatggaggagatagaagagataatacggtttaatcttagcgtggggcttccgataactttggaagatatggggatcgctgcaaatgaggaaatctatagaacgatagcaggagaaccgggccaaagcgaatggcaaagagagcctttctacacaaacgccgagacagtcgcggacataatcaaatgtgctgatgagttgggaaaaatgtataaaatgcaataggccaagagattgcggcacaaggtgagtattccttgtgaaattggaactgagaaagaagaggcttgtgcaatgaaaaggatgatagaactgtttgaagataatcctgtgattccgggggttatcagcgatgcagatgtagaactggtattaaaaaatgaggcgaagattgtctttacgctttatggggatatcgctgatatcgccaatattataaaacgactcaaagatggaggaaaaacggtttttgtaaatattgacatggtggatggcttttccggaagaaattctgtacttaagtttatgaggcagaatactctggctgatggagttatcagcgctaaggcgtctatgcttcggtatgcaaaggaactgggattttacacagtacacagattttttatacttgattcttctgcttatagaagcataggaaagcagatggaaattagtaaagccgattttataaatgtggtgcctggctggacaaaggttgtagagtggacggtagaagagcataaaaaacccgtcatttcggcagggctggtgtgcgataaaaagatagtgatagataatctgaatgctggagcgattgcaatctgtagtaccaaccataatgtgtgggaactataggagagtgaccgacagtgatgaagtacgtggaggcagaacttgaaaaagaaggagagacgctgatgggacatttgacgacaaaggatgcatacaagaacttggaggagcggatcaactggtttacccagggagcgccgccgtccgagactttatatcagattcttcaggtgctgtacacggaaaaagaagcaaaatgggtggccaggctcccggtgcgtccatttacattaaagcgtgcggcgaaggtctggggaacgacggaggcgaaagcggagaaactgctgaatcatctctgcgagaaagcgctgcttgtagattcggattaccatggagagcgccagtttgtcatgccgcctccgatggcaggcttcatcgagtttgcgctgatgcgtaccagaggcgatattgaccagaagtacttaagcgaactctattatcagtatatgaatgtggaagaggattttgtaaaagacttgttctttgccacggagacaaggctgggccgggtctatgtgcaggagcctgtcctgaccaatgataagacgaatcatatcctggattatgaaagagcaacgcatattgttgaagaagcccaatatattggggtgggaacctgctattgcaggcataaggcatatcacgcaggacatccctgcgagattgacgcgccttgggatgtatgcctgacttttgataacgtggcccgctcgctggctgagaacggcggatatgcccggcttatatccaaagaggaagcaaaagacgtgctggagcgttcttatgcgagcaacctggtgcagattggggaaaatgtccgggagcatccggcatttatctgcaattgctgcggatgctgctgcgaggccctacaggctgccagaaggtttgcgcccatgcagccggtggcgaccaccaattatattccagaagtttcagatgagaagtgcatccattgtggcaaatgctccaaagtctgtcccatcctggcaattgccatggaagaggggaagcctccggcgattgataaggaaatctgtctgggctgcggcgtatgtgccagaaactgccctacaaaggcgatagaattaaagcgtcgcccgattcaggtgattacgccggttaacagcacgcaccggttcgtgctgcaggctattgaaaaagggacgctgcagaatctcgtttttgataatcaggcctttgccaatcaccgggccatggcagcagtctttgggacaatcctgaaactgccgccgcttaagcaggcgatggcgagcaggcagtttaagtcggtgtacctggataaacttttgtctttgcataaaaaagaaaaacaataagggttttgtgttataatttgacattataaaaaggatagtgataaaatggatagcagtcatattgatgaaaggaatgtacaaaatgtcagattttactccgcttacaacaaataaattatatattcagatttatgaacaaataaaggacgctgttttgcgggggaaatataaggttggagaaaaattgccaagtgagaaagagttttgccagatgtttaatgtgagcagagttcctgttcgggaagctctttgcgcgctggaattaaatggactagtcgaatctgtacgtggggcaggcgtttatgtaaaaacaaattcctccattttaaccatggattggatgaagcatgtggatgtacaggatattatctgggcaagaatcgcaatagagccattaattgcaagggaagcggcaaaaaatatcacggaagatgggaaaatcaagcttcaggcatttttggatcagttggatgcagacgcagatacaattccgcttgctcctgatctcgaatttcatagaacgatagccgcgatttcgggaagtaatctatatatcaatcttgctgaaatgatttataaagcaattgaagaaagtgtttggagcagtttcatccagcatacgaaaaaccaggtaggcgacttcgagtttaatgaacaatatttggaagatcattcaacaattgccgaaaagattatgaatggcgacgtagaaggagcttataaagcgatgcggaagcatatggaaatctggattgaacagcaaggtctccaattttaattgaatgatggttgaaaataaacttatgaaacctatatagaataaaaatttctatataggttttttgttgttattttgcaataattgggaaaatgcacaaaaaatataatattgtattgtgtaaattgacatttattacaaaactctatatacaaatgcagaaaaaaatgataatatttgtatagttgtaatacaagcatacaaataaaggaggaaaaagacatgtcaagaaagccatatcaaccgcttccggtacggccggacgcggatagttcgttcattcggaaaaaattaatgaacatcccgtatgcacaggaatcaggagcgcaaaaattggatttgtactatccaaatgaaggagacggcccatttcctaccattgtttattttcatggcggcggattctttatgagagataagacggatgatcagtgccaggcattcctaaatcttacaaaagccggctatgtggtggcaagttgcaattatcgtttgactggcgaggcgtatttcccggctatggtttacgatacaaaggcggcaaccagatttttaagggcgaatgctgctacctacaatctggacgcagacaaatttgttgcggccggtcaatcggccggaggatatctttcggtcatgctggcggccacggggggaagaggaatattagaagatctatcacaaggcaacccggatatatcctcaaaagtacaggcctgtattgactggtttggtgttgtcgagtttgaactgcaagaggaacagttgaggcggaatgggaatagttcttttaaatttagtaatgtagattcatccgtaacagacatgttttttggagcaaagtacaggacgataacaaaagaaatgaaacaggaggcaaatatacttggctatattaccgagtctatgccgccaacgttgatccagcatggattgatcgatcatctggtcccttatcagcagtcaaagatgctggaagaaaagatatgggatatctgcggtcgtgataaagtgaggcttgatattttggcagacgcagaccatgatgatccattgtttaacacgccggaaaatgtggaggaacttcgaaagtttctggataaagccttgaaaattaatagataaataacaggatggaaatggaaagagaggtatttgtatgccagtagatattataaaagattttgcttatgccggctttttgcttttggtcggctacattcttcgttataaggttccgtttttacaaaaactatatattccggcttccgtaattggcggtattatcgggctgctgcttggaagtcaggtgttagggaaaatctcgtctgtttcgctgtcattctctgaaaatatcagcgcattcgctatgccgctcctggcagttgtatttgcaacacagctgattggagcaaaattcaacagggactctttgaaaagcggcctcaatgtattccttctgaattcaggcacggcatgcctgcaggttggcctttgcgctgcaattatgctggctttcatagcgatgagtgctacgaaagccccaatcgggatgagcgtgcttccgtttaccgggttttatggcggtcacggcgtgccagcgattgccgccggaatctttgaacagcttggacattgggattatgatacagcggtatcggttggaactacattcgctacgatcggcctgctgtttggtatcattgttggtatcatcatcatcaatattgccgtcaggaaaggaatgatcgcggcaaatgccggactctccagtctatccaaagaagaactatctggctttgtcccggaagagaagcgcatctctgcggtggatggagtgaccacgaatgatgcgatgaatcccgttgctttccaaatggcagtcatttgcagtattatttttttcgcctataagttgatggatactcccatctcattattcagcacatgggggattacaatctgcgcattgcttgtaagtgttttttatacaattgcaggaaaggcaacatcgcttggcaggtggcttgatcgtaaatctttgacaaatgtatcaggcgccgcattggagtttctgatcgttacttcaatggcttctaccaatttaagcgtttttgctacatatggaaaggaacttgtcattcttggggtggcaactgctataggaacattagcatatgttatgttttttggaaagagatggcataaaaagaattggattgaaaactctcttggaacattcgggctggcgaatggcgttctggcaacaggcttcctgctggtacgcgtagcagacccggataatacgacaggagcagccttgaatcttgcccttggtaactctatcagtacaatatcggttcagatgttcttcctaatgttctttccgggcctgatcgttaccaatacgacttttgcaatctcaatagcgatcattggatattttgtgtttaccattgcaggctgcgtaataaacagaagaaagaatgggtaaaatcaaattctgaaacttgccgataaacatttaaagattaatgtataaatctcctgaaatcccacagaataaaaagaaaaacggagcgagggatcaggttatggaaaaacagacggttgaattattaaaggaatgcaattctgggtgcaagatggggatcaacagcatgaaccaggttcgggaatatgtaatggatgagaaacttgcgaaggtactgaaagagtatgacgagaagcacaagaaactggagaaggaaacttctaaactgctggcagaattcgggaaggatgagaaggagccggaaaagatagcgactgcattttcctggatcagcacggagatgaaactgatgatcaaggatgacgcctcccagattgccaagatcatgacagatggctgcaacatgggaatcaaaagccttacggaaaagatcaaccagtattcagatgcctccagggaaagcatatcgctggcaaaagacattgtcaaatgcgaggaagctttccgggatgatctgaagcaatttttataaagatcaataatgtagataaaatggtgccagagtgttgattctggcaccatttgtgattctagatatcgtccaatgggaagatgggtctttgtatattttgcaagggcagggtttccagatttccggtactgatccctggcggatctacggtgataatatttccgctgattttttcaaaatatgctttgaagtgctgcgctgattttacagagacgatattgtattcttttacgtctatgcctaacagtaagaaaatgccatcatccataatttgaaaagcattagacgcaaccacgatatcaacatttcctttttgaaggcgaacggtcctgccgaagttcacgggctgtccatgcgtcatagggctcattatattatatttaccgtcagtgatggcttttacatatacatcttcaagcgcgacaggagttccgtggagagcgtccgttttgccgcccagcataatattgatcctggctccgactccggcgctgaccgccagagcgactgtctgtgggtcgataatagcaccgcagcaagtttttggaatgtctcgcctgatcaattctctcagaaggaaggttccatctcccggagttcctgcgcctggattatcagatgcttcattcatgataatggggccatgggatctggcaagaagcgcttctgccaagtctacgccttgggttactgtcaggcaatctgagagaaagtccttacggttctccatcacataatctccgatgtcattggcggtttcctgggcgagttcttgattcccgtctgtaattacgacgacggatgcgccgcattcttcgatgtcgctatagggaaacccgtgcacgaatgtacaggctatcattcctgcaatagtttctttttcggagcatttttccaatagggttttcatgggggcttcatcggtacagcctttggtaatgggaatcaatagcggtaatttttttacatgcattacaggactgatcttttggtccagcagatccttcaggagttgggcagccttttccccggtctcgtaagtgtctgtatgaggatacagttttgagggtagcaacagggctttcgactcgatcatcttcctggtgatattagcatgaggatctaacgttacgacgatggggacttcataaccaaaccgccttctgatttcttctaacacggcgccctctacgtcgggttcgtcctgggatacgccggctccgtgaagagccaggcagaagccgtcgattggcttgtccgtatcgattccatcaaagaatctgtccatcaaagtctggaagcaagaggctgatattactccggatggacttgcaaatgtacagaaacaaggggcaatttccattcctaattccgtacccttttctatgattcctgttaaatagtctcgcatgccaatttccgatagctggaatacatcgttcttttcaaaccagatgagggttctgcggaaattttcaacttccgtaggatgcttggccaaagaactgctttcatgcatgatctggcctgctacaatatgtttcatattcttgttcctccaatgcattattatgctacttaaagatgtttgctgtgaaaacggcggcataattaccaatgatgtagccgtacagacctactaaggtggctggcgcgatcagactagaccagcctttgccgataacgtatgcggcggctgtcgtaggccctcccaacgcagcattagatgccgtgaaacattcttcaatgttccatttgaatagtttgcctaaagccatggttccgccaatattgatcacaaacattaatattttgaatcccagtaccacaggagcaagcatgataatctcgctgattcttgccccggcgccgatctgtacgaaccacatcgtaatcatgatggttccgatttccgtggcgccatgaatgttttcaaacacctttggaaaagcagtaaccagaatgatcgtaatggtggtcataacgagatagatatttccgaataaagtcttaacgagccctggcagagatgaggcatttactatattgcataagatctgggtaacggctaatattccgaaagtgatcgccaggcatttcgcgatgtcaagcagcgatatatcatttcgcttccagaatttcgccgcctgtgtctccccgtcatcgacagagattcctgcttccagcgcgtctatatgttcgtgcttgaaatgctttcggaagaatttcatgtttggcatggcaataattgcggccgtccagagaatgatcaccagattgcctatgatcaatgaagcattcataatgctgtcatctactttaaaagcatttgccattgctacgagattcacgcctccgccgatgtccgcgcctacttccacagccacatatcccgcggtctgttcggccagtttatcgctaaaaatatagccgcataagattcctccgataacgctggcaagcgccgcgacgtggaagattaggaataattttccgctatccttaatgatcttcttcaaattggattgaaacagtaatagaggaatggccaaaggcaggatataatcgcctatcgcagtaaataccggcgaggttgttggcataatccttaaatttactagaatcagagaaccaattaacgcaagcagcacgctggaaatctttgcgcctattttatatttttgctctatataaaatgatagcgcggtaatacctatgacgatagcccacagtgtccatgtatcatccggtgatataagtgttgacataatataagcctcctttaaatttttaagtccggggatgcgcgcacatccatataacaacctgtatatctgttgttctttacaatattaagatatcatagaagcgtttcggatgagtaatataaaaaattgatatggcatttgtttttcatatgtgttgtcgggcgataggattaggcctgcaagatttgcgttttgatagaaaaaaagttataattaatgcattatggaaaggaaagggggagaagtttcgtgaagattgaacagcttgttcaagtgatcgagatcgcaaaaacttgttccatcactcttgccgcaaaaaacctctatatgtctcaatcaaacctgagtacttctatacgtgagcttgagaaggagatgaagcagaatatattcgtgcgttccaataatgggactcagctgactcctttcggagaagcatttctaattcaggcgcgatccgttgtaaagcaatttgaatatataaaaggcatgtcatccaaccaagataaatggagtattaaatttaacgtttcttcgtactattttttgttcgcggtatatatctttctagatctgtttcaaaataatcgtaatcaaaatatggcttttgaattgagggaatgttccagaagcgggatcatccagtctgtcgctgacaaggagtctgaacttggcattctgagcatccctaccttgcaaaaatctaaatggctggagtttatcaaccgcaaagaactggagtaccacaagatcatagaagagcctgcgcatatattgattggggagaattccccgcttaaccaggcatttgacggatctgtacattgggaggaattaaaataccttcctatgattgattttctggaaccagaagaagccttcagcgggatgaaagatcaatacttagacgtcctggagcctgatacgatcattcatgtctcagacagagacagcctgatccgctttttgaatacgaccggctgttatcatattgcaaccaaaaatataaaggcgtatcgtgaattcttattccatgaatccataaaagccattccgatcatagactgtccattttctctggaaattggctggataaaagaaaagaatagttatttgtcagaatccggaaagcaatttcttattaagactcaggaattacttgtcctggagaaccctccgatcctacaataataaatagaaagccggcaaatggccggcggcttattcgacatctatataaaaactgccaatagacattcttgatctattggcagtaattttatgtacttatattaccacaaaatcgacaatttttcaagtcttgtaagcgtgccagccagggagtagaataggaaatcactacaaaggggtgatggaatggattatgagatggaggaactgattcctctggtaaaggaactctgtgacagatatacagggaaggaaagcacgtccgtgacgtatgaggcagcccagcagctgatggaagccgtactctactgtattcatgagacggcaggggacgtggatgcggccggcgtctcggacggaaggcggacggcgagaatggcgtacgagtatggctatgaactggcggttcgaaaggtgggacaggcgagagagttatataatcggatggcagaaaattttcgaagttatgggaacaaagcctatgaggagacatttagacgtggaattccggcattcttcctatggtatgacgtccggctgaagccgcaagatcatatcattactatggattatccggtcatgaagaatctggaagggctgtgcggcattgatgccatatgggagtatctcaggtgcctggaagcggagcagacgttcctggcaagattcccggaagactatatccgccaggtgaatgtggcgcgctgcgcagactatgaggaatacttcatcaatccgtgcagggtaatgctccgccatgtcctatgctgtatgcttgcggacattccggcagataagatccggttcggggaggaggactatacgaagttgaaagaggaagtacgaggccaggaccgggaaggcctaaagagaaggctgacacgccttttatatgtacttatgaagcagaagtactgtggggatgagaaactgtctgggtatctggaatatgatatggcagacttggcttttgaacttcaaaatgctgccagtcatggctgtctgccagcggtggtgtaggctgggaaaggaaggcgtattatggaagaatggtttgaacttatgactttggaagcaagcaggcaggaactaaagcgcgtgcttgaatgcaaccaggagacatcgaagtacgggcttagtctgacggaggaagaagctagggaactgatggcctgccggaaggagacgctaagggagagcaggagagtagaattcgcagccggaatactcccggaactgatcaaggagttctgcgattcccagttcatccagagcggggagtatgtggacactctggcaaggcttcaggagatattctatctgtataagaatgaatccatggacgaattgacagatggggaactgctggagattatgaaggagaactttgaacagatctgctacggagatctggaatacctggagacaacctgtctggaacggttcgcggctgcagtccgggccggatatgagacggaattccagaagaaggagagggatgagtatacgcttaagaagagcgggaatgagtatgagaaattctcggaagagaccagatgggaatttgaactgtataggataaaattggaagagtcggaatagaaaaactggttgacaaaagcgtaacaagttactaaaataacaataagtaacttgttacgcttttggaatatgaaaggagagttatgaaaaaagagaattcagttacatatgagcggatgggaaccagccttgactggataaagaagctgattttcgcgggagtatttatccaggagaataagctgcacgccatatttgaccgctacaatgagatgtccagcaagcagtggcttttgatggcagtgtcggcttcgtttgatgcgccgcctgacctgactacgctggcaggagccatgggatgttcccgccagaatgtgaagaagctggcagtcaatcttgagaaggccgaatatatcaaactggtaaagtcggacgcggatgctagggcgctttgcgttaagatgacagaaaaaggcatgaagttcgcggaatatatggcggatgtcacggatgacgtgcatgcggccatgttcggtgaatttacggaggaagagatccgcaagtactaccagctgtcgataaagctgatgcacggaatcgaccatctggaatcgtattttcagaatcagagaaaaggagaagcagacgtatgatcagagtcatgtataagagcaggaagaataataagaaggtggcgcaggccatggcaaaagcgctgggggtagaggcagagagcattgacggggcgcaggaggtaaaagccgatctattgtttctggggtgcgcagtcctgggcggaaacgcccggccagagatggagcggtttgtagaaggactggatagcggcagcgtttccagggtggcgttattttcatccaatggatatggcacggatcagttcgccgccttaagagagaaactgaaggcaaaaggcatagaagtggaagctggggcgttttcctgcaaaggaagcgcatttatattcaaaaacatgggaaagccggatcaggaagatctggaggcagcaaagcggttcgcgttatccgtcagggatggcagaaggagttaaccaatggttgattttgtttccgtaaatatcgtatcattccatggtgttttccagaattattccgtatactgatagcaagaaaggagatgcgatatatggatacattgaatttggcggagaacctgatccgcttgcgccgggagaaagaagtcacccaggaagaggtggctagcttcattggcgttaccaaagcgtcggtttccaagtgggagacgaagcaaagccttccggacattctgctgctgccggtgcttgcgtcctattacggcgtgacggtagacgaactgctgggctataagcctcagctggggaaggaacagattcagaagatctatcatgacctggcggcagaatttgcggaaaagccctttgaagaggtgatggacgcaagcaggaaactggttaaaaagtattactcctgctattccttcctcttgcagatcagtattctgtggctgaaccattatacatttgccgaagatccaaagagtcagatggggattctggatgagacggtggaactgtgcacgcacatcatagaaaactgcaaggatatcagcatctgtaatgacgcgacggtactcaaagcgatcatggacctgcagcgcggaaggcctcaggaagcattggacttagtggaggatatgctgagtccctaccggctggccagccagagcagcggaattcttatccaggcctatcagatggtgggagatatggataaggcggtcagttatacgcagatcagcatgttcctccatctgctgtccctggtagaaggagcgacgcagtatattgcgtttcgtgcacaggataaagagtcctgcgaggagacgatacgcaggatggatggactgatagaattattccaattagaaaggctgcatcagaatatagcggcagtctatcactaccaggtggcagtctatcagtgccagcaggaggatatagagggagtgttcgcaagacttaaaaggttcgtggagattatctgcgatctgctggatcatgaggcagccttgcatggagacggttattttaaccggctggaagaatggtttgagggactggatcttggaaagcagatggtcagagataagaagctggtcttagacaacgcttgccaggctctggagaacccggtattttctccgcttatagaagataagcgtctggtaagattgaaaagagtattgacggaaaagagggagacattatgaatataaaagatatgctgccatttttgataccattggtcattgtagagctgattcttgtgattatcacgcttcggcacatcttcacgcaccagcactataagagggggacccgcgcgttctgggtagtgatgaccatcgtggggatacagttttggggaccgattctttattttctgctgggaaaggaagatgcttagatggatatgctgacattatcccatgtatccaagcgctttggcgcaaatcaggtgatcgatgacttgaactttaaggttccggcacattcgatctatgggtttatcggacagaatggggcaggaaagacgactacgatgaagatgatactggggcttcttaaggcagattccggagacatccttgtaaatggcgagaaggtctgctatgggcagaataggacgaaccgctatattggctatcttccggatgtgccggagttctattcttacatgacgccgatggagtacctggcattgtgcggcgagattacgggaatgcagaaaacactgatccgcaaacggtcaatggaactcctggaactagtaggacttgagaagtctgacaagagaatccagggattctcaagagggatgaagcaaaggctgggcattgcacaggccctccttaacagtccgaaacttctgatctgcgatgagcctacgtccgccttggatccgctgggaagaaaagagatactggatatccttctggcggtaagggaacatacgaccgtcgtgttctctacgcacattctctctgatgtagagaagacttgtgatgagattggcctgctccatgaaggaaaggttgctcttcaaggtactatagaagagatccggcagattcggaaaagcgacggattcgaagcagagttcaggaatccggcggattcagaaaaagccctccggttatgggcaggaggcgagcgcaaggggaagaatctgattttctttgcaaagcaggatgagaaagatatggcatccgccatgcagggcatgtcaaagtccggaatctatccgcttcgcatggaaatgcgggaacctacgctggaagcgttgtttatggaggtggtaggaagatgaggcagttaagcgcatttctaagaaaagaaggaatggagttcatccgtacgggtaagatctggattcttctgatcatattcatattgtttggcatcatgaatccggcaatcgccaaattgacgccctggatggtagagacgatgtcagacagcctggcagagtcggggatggtgctgacggaggttaaggtaaatgccatgacttcctggaaccagttctacaaaaatatatccatggcgctgatcatctttgctctgatgctcagcgggatcctgacaacggaataccagaagggcaccttggtaaatatgctgaccaaaggcctggtcaggtggaaggtagtgggggcaaaagccatcgcgtctatcggtctgtggacagtctgctattggctgtgctatggcatcacatacggatataatatgtatttctgggataatagcatcgcctcgcatgttgcctttgcggccttgtgcgtctatctgctgggaatctgggtcatgctcctgatcctgctgatatccacgctgcttaaatccgcttcaggggtgctggcagtgacgggcgtagcagtcattgccagttatgtggccggaatgttcggaaagattggggaatatctgccgatacggctgctctctgctggtaatctgctggcgggcagcatgtcacctgaggatttctggaaggcgatagcggtggccctggcatctggcgtggcgttctttatattgtcagtggcgtgctttaatagaaagaatattggatagagtgcctggggaattgcgattccccaggcttgtgttataatataatccataaattagaatggagatgtattatgctgtacacaatacctgactattatcagaatttcaaatgcacggccgatgagtgcgaggacacctgctgcgccggatggcagattgccatcgacaggaaatccctggtccgctatggaaaggtgtccgggaagtttcgaagaaggcttaaccgttccatccggtggctggaaggaacctttaagcagggcgagggcggaagatgtgcctttctgaatgaagagaatttgtgcgatctgtattctgcccttggcaaagagagcctttgcaggacttgcaggctgtatccgaggcatatcgaggagttcgaaggcgtgcgggaagtcacgctgtccatctcctgcccggaggtggcgagaatcctgcttaaaaaagaagaaccggcaaggttcctggaatacgagaaggaaggcgaagaagcatatgaagattttgatctgcttgtgtattccaaactggcggagggacgggaggtcatgctcaatatcctaagggaccgggaacttgggcttgagttgcggactgggcttgtgctggcgctggcccatgatatgcaggtgaggcttaaaaagggagaagtgttttcctgcgaccaggtctttgaacgctaccagaaagaaaaagccagggaatttatcagactgaaacttatggagtcgggagacaatatagaagaaagatatgcgttttccaggcaaatgttccagaacctgtaccagctggaattactccgggaagactgggagtctcatctgcgcgagtcggagtacctgctgtatggaagcatggatgacagtcaggatagccgggacgcctatgggaagatgcatcaggatttcgccgcatggcttacggccaatatgccggaatgggaaatccagtgcgagcagctgctggtatattttatctatacgtatttctgcggggccgtctatgacgggagagcctacgcgaagatccagatggctgtggtcagcgttatgctgatctacgagatgctggcggcaaggtggaggaagaatgagaagcagctggactttgaggatgtggtggagattgtctaccgctattccagggaagtggagcattcagaccagaatctggaggcaatggagcaaatgatggtagaacaattgatcccatggttttcaaaggagagatgcaaggaaaggattgagggaaaggaaggaaagatatggatgtaaatatgacaggaaatacggaagaaaatacgcaaagagagcaaaatctgaaaactgcgggacaactgttttcctttatacaggcaagtcccagccctttccatgcggttgcgaatatgaagagggaattggacgcgcacggatatgcccagcttctggaaggggaagagtggaggctggaagaagaggggaaatattatgtcatccggaacgggtcggcattgatcgcgtttcgaattccgaaacgagatttcacaggattccagattatggccagccacagtgattctccaagtttcaagatcaaggaaaacccggagatggatgtggaagggcattacgtgaagctgaacgtggaaaagtatggagggatgctgtgcgcgccttggtttgacaggccgctgtccgtggcgggcagagtcattgtaagggacggaagccgcctcgtgacaaggctggtgaatatagaccgggacttgtgcatgattccgaatctggcgatccatatgaaccgggaggccaacgaaggctacaaatacaacgtccagaaagacatgctgccgctgtatggatgcggaggatccgggggaatgttcatggaggacattgcccgggcagcaggcgtggcgcaggaggatatgataggaagcgatctatttttatataaccggatggaaggtagcatctggggagcgcaggaagaattcatttccatcggaaggctggatgacttacagtgtgcctttgcatccctccaggccttcctggaggcggatggcggagaaagcattccggtacactgtgtctatgacaatgaagaggtggggagcggtacgaaacaaggcgctggctctacgttccttctggatacgctgctgcggatcaatgaagggcttgggcgaagcccgggccagtaccgccaggcgctggcatccagcttcatgctgtctgcggacaatgctcatggcgtacatcccaattatccagagaaggcctgcccgaccaatcggccttatctgaatgaaggaatcgtgataaaatacagcgcgaaccagaagtataccacggatgggatggctgcggcagtatttacgcagatctgcgaaagagccggcgttcccgtgcagaagttcctcaaccgttcggatattctgggaggctctaccttgggcaatatctcgggaacccaggtggcgctgaattcggtggacatcggactggcccagcttgccatgcattctccgtatgagacgggcggcataaaagatacggattatctgatcgcggcggcaaaggagttcttccggacatcggtggtggaaataggcagcggagaataccgggtgaaggagtaagaagagatcctcccgctctttgacttctgctcctaaaagtactataattcgatagtaaatgacagaaagggagttggaaatcatgagtaaaagaatcgacaagaagagaatgaagagacaggcggaaatcacatctgcaccgcgcgatataaaggcgccggcggcaaaagaggcagagaatatagacttctacatccagtatcagggccaggagtacctggagagggagattatagagcgaatcaaggaaaaatgcaaggtagagggggctttgacttcaggaaatgaaaagttatctgtctacctgaagccggaagaacagaaagcgtactatacgtgcggcagcttaagcggggatatagatatctaacccatgaggaatagataaggctccgggacggccatggcaaatatgccaggactgtcccggagcctttggtttatatgagatttattctacaaaaccgatctcgctgtgcaattgctgcaatgattttacatctccgttgccatgctctttcacgtagcggattcccttagcagttgcccttgcagccgcgatggtggtcatgtaaggaatcttgcctttgatggcagccttgcgcaggtaactgtcatcgtggacgctgtccttgcctaccggagagtttacgatcaggtcgatcttgccgttggtgatcatatccaggatattcggacggccttcgtagagtttctttaccttctcagcctcgattcccgcttcctggatcagatcacaggtagttcctgtagctacgatcttgaatccatcttcggcgaagcttctggcaatctctacgacctctgccttgtccttgcggtttacggagatcagtaccgtaccgttaagaggcagtttggactgggcggcttcctgtgccttatagaaggcttctccataggatggagacaggcccaggacttctccggtggaacgcatctcaggccctaataccgggtcgacttcctggaacatgttgaacgggaatacggcttccttgacgccgaagtaaggaattacctgttcttttaattccggtaccggcgatgggcgtcctgtgatgtcggaagtaatgatgtctgttgccagaggcaccatgcggatgttgcagaccttggataccagcggtaccgtacgggatgcgcgtgggttggcctccagcacgtatactttgccattctcgatggcatactgcatgttcatcaggcccttgacatgcatttcttctgcgatctttcttgtatattccttgatggtccttacattttcttcagaaatatgtacggacgggatgatgcaggcggagtctccggaatgtacgccggcaagctcgatatgctccataaccgctggaacgaatgcgtgggttccgtcgctgatcgcgtctgcttcgcactcgagggcgtggttcaggaaccggtcgatcaggatcggacggtcaggcgttacgccaacggcagccttcatgtatccttccatgctttcgtcatcatagaccacttccatgccgcggccgccaagaacgtaagatgggcggaccataaccggatagccaatctctctggcgatagccagcgcttcttcaactgtggttgccataccagattccggcataggaatctctaatttttccatcatctcgcggaacaggtcgcggtcttctgccaggtcgatgacagatggcgaggttcccagaatcctgacgccattcttctcgagttcggatgcaaggttcagaggagtctgtccgccgaactgggcgataacgccaagcggcttttccttattataaatgcttagcacgtcttccagagttagaggctcaaaatacagcttgtcagaagtatcgtagtcggtggaaaccgtctctggattgcagttgacgataatcgtctcgaatcccagtttcttaagagccagcgaagcgtgtacgcagcagtagtcaaactcgatgccctgcccgatacggttcgggcctcctccgagaatcatgatctttggcttgtctgtacttaccggattcttgtctggcgcattataggtagagtagtagtaagcgctgtcaggcgttccgcttacgtgcacgccttcccatgcttcctccacgccaagtgccaggcggcggttgcggatatcgtcttccggaatctccaggatctggcttagatatttatctgagaagccatccttcttcgccgcggtcagcatctcgtcggatgggaggcttccttttccggctgcaagcgcttcttcttcctccaccagttctttcatctgctggataaagtaagtcttaaccttggtgatatcgaagatctcctccacggtcgctcctttgcggagtgcttcatacatgatgaagtgacggtcgctggacggagtgatcagcatctggagaagctgatccttagtcttcgcgttataatccttggcgtaacccaggccataacggccggtctccaggcttcggatagccttctggaaggcctctttgtaagtctttccaatactcatgacttcgccaaccgcgcgcatctgggtgccaagcttatcttctacgcctttgaacttctcaaacgcccagcgggcgaacttgattacgacataatccccatccggtacatatttgtccaaagttccatacttgccgcaagggatatccttaagcgtaaggccggttgccagcatggcggataccagggcgatcgggaatccggtagccttggaagccaatgcggaagaacgggaagttctcgggttgatctcgatgacgacgatgcggtcgctgacaggatcgtgggcgaactgtacgttggtgccgccgataacctgtacggactctacaatcttgtaagcctgttcctgcagacgcttctggcattcctctgaaatagtaagcatcggagcagaacagaaagaatctccggtgtgtacgcccagggggtcgatattctcgatgaagcacacggtaatcatattgttgtcggcatcgcggacgatctcaagttcaagttcttcccagcccaggatggattcttctaccaggacctgtcccacaagactggcctgaaggcctcttgcgcataccgtctttaactcatctttattataaaccaggccgccgcctgcgccgcccatggtgtaggctggtcgaagcacgacaggatagccaaggtcatcagcgattgccagtgcttcttctaccgtgtaggcgacttcgcttctggccatctcgatgccaagggcatccatggacttcttgaattcaatacggtcctcgccgcgctcgatggcatccacctgtacgccgataacctgtacgttgtacttttccagaatgcctgcctttgcaagttctgaacaaagattcagcccagactgtcctcccaggtttggaagaagcgcatccgggcgctctttggcgatgatctgctcaagcctctctacatttaatggctctatataagtgacatccgctgtctccgggtcggtcatgatagtagctggattggaattgaccagcacgatctcataacccagcttgcgcagcgctttgcaggcttgggtacccgaatagtcgaattcgcaggcctgtccgatgatgatcggtccagagccgataataagtactttgtgaatatctgttctctttggcatatgtatcctcctaatatgacatgcatggcttatggaacgcccggttgcgtgtgcgattgcgggcctccaaaaaaccctttaccctctattatatagtagattgaaaaaaagggaatagggaatttcaccaaatatggagaaaaatcatggaaaatttctcaattttttggcataaaatatatttcttattaaactgtgaattgtaaaagcctctttcttatgataaagtgggtatagataaatgttgattaaatttatatgcaaggggataaaagacatggaaagaagagtaggaactatatcaagaggaatccgctgcccgattatccgtgaaggagacaatctggcggatattattgttgaaagcgtattagaggcagcagaaagcgaaggattcgagcttcgtgaccgcgacgtgattgcagccacagaatccatcgtggcaagagcgcagggaaactatgcgtctatcgatgcgatagccaaggatgtcaagacgaaattgggcggagagactataggagtcatctttccgattctgtctagaaaccgtttctccatctgtctgaagggtatcgcaaaaggcgcgaagaaggtagtactcatgctgagctacccaagcgacgaagtgggaaatgaactggtttccctggacaagcttgatgatgcaggcattaacccatacagcgacgtgatggatcttgagaaataccgcgaactgttcggagagaataagcatccatttactggcgtggattatgtgcagtattacagcgatctgatcaaagaggcaggggctgaagtggaagttatcttcgcaaaccagccgcaggaaatcctgaagcatgccaagaacgtgctgacctgtgacatacataccagggcaaggactaagcgcatcctggagaagaatggcgccaaggttgttctgggactggacaatatcctgacctgtccggtggacggaagcggatgcaatgaacgcttcgggcttcttggatctaataaatctacggaggaatccgtgaaactgttcccgagagactgcacagacctggtactggaagtgcagggcaagattcttgaaaagaccggaaagcatgttgaagtcatggtatatggcgacggcgctttcaaagatccggtagggaagatctgggagctggcagatccttgcgtatccgtggctcacaccgaagggcttaacggcacgccgaatgaagttaaattaaaatatcttgcagacaatgactttaaagacctgaagggcgaggaactcaaagacgccatctccaagagaatccaggagaaggaggacgacctggtaggcgatatgtcttcccagggaacgacgccccgccgcctgacagacttgatcggctctctgtgcgatctgaccagcggttctggtgacaaaggaacgcctgtgattctggtacagggctattttgacaactttaccaccgataaataggcggcagccaggcagatgctaatagataatgaaggattaatgataggaaaaaatactcaggaggaaatgaaacgaatgaaacaggatatgattgtaattctggatttgggcagtaccgaaaatacggtagttgccagagaaattcgcgatatgggcgtttacagcgagattcatccccatgacatcaccccggaagaattaaacgggctggataatgtgaagggaatcatcttgaacggaggagagaaccgtgtcgtagacggagcagcggtggatgtaagtcccgcactctatgatctgggatatccggtgatggcaattgaccatccaacagccaaatgcgcacagaaactggacgcgcttccggatgaggctacccttaagaaattcgtattcgacgagtgcaaggcggagccaaactggaatatgaagaactttatcgctgaccaggtagaactggtgaagcgccaggtaggcgaccggaaagtccttcttgccctgtccggcggcgtggattcttccgttgtggcagcgctccttttgaaggcaatcgggcagcagctggtatgcgtgcatgtaaatcatggcctgatgcgtaagaacgagtcagaaagcgtagtggaggtattccagaaccagcttcacgcgaaccttatctatgtggatgccacagaacgtttcctgggcaaattggaaggcgtgaaggatccggaagaaaaacgtaagattatcggcggagaattcattcgcgtatttgaagaagaagcaagaaaactggacggaatcgacttcctcggccagggaaccatttacccggatatcatcgagagcggaaccaagaccgccaagatggtaaaatcacaccacaacgtagggggattgccggaggatctgcagtttgaactggtagagcctttgaagcagctcttcaaagacgaagtccgcgcctgcggaatcgaactggggctgccgccgcacatggtataccgccagccattcccaggtccggggcttggcgtcaggtgcctcggcgcaattacaagagacagactggaagcagtccgtgaatcggatgccatcctgagagaagagtttgagaaagcgggactggataagaaagtatggcagtactttacggtagtgccggactttaagtctgtgggcatgaagaaccatgccagatgctttgaatatatggtaatcatccgggcgatcaatacgatcgacgcgatgacagccagcatcgagaaagttgactgggacgtgcttgagaagatcacgaacaggatattggcggaagtggagaatgtcaatcgagtatgctatgacatgtcaccgaagccgccggctacgattgaattcgaatagcggacagaaccccggagatgcctgtaaaatgggcgtttccggggttcctttatgtcgtttgactctattttataattttgattagcaataaggagttgattatatgcctagtattttaccagtatctgatttgagaaattataatgaagttctcaaaaattgcaaagttggagaaccagttttttaaccaagaatggtaagggaaggtttgtagtgcttgatattgacgactacgagaaagaccgagcagagaaaaaaatgttggcaaggttgcaggaaacgaaagaaactgttgcagatgggacaggttggttgagccttgatgaattaaaatcggctatggaggaatagcacttgatgaaataaaggattaaccctctcgtagtagccgatctgaaagcaattaaggattatactgcagaggataatgcagaagcagccagaaagacagtagacgagatttacaagagttttgagaacttacagcagtttcctactatgggagcagatttgtcaaaactagtgagtttcaagacagattataagtatcttgttcatgggaattatattacgctgcatcttatcaaaaaggattacgtagagatatatcgtgtgattgacagatatcaagatataacgagcattttatttagatagatttgaatttagaggaattatgctgccactctattaagcgatttataaccgaaatgaccgtagttattgggaagcacttgatatagatttaaaaggatatgccgctaaaatcggtcttgactatgtgaccaatgacgatagcgtgagtcgtcctttcggcgatccacccgtgattgtcaattatttctatcacagtgaaatcaaaaaatcagcaagaaaaggcgcaatacatccgtcggacgcatgttctgcgccggccagagcgaagagtagaggtgcgaacaatgcctgaattacctgaaatagaaacaataaaaaacgtaattgagccacacatctccgaatgtctacgctattatgcacggcagagaataaaatggctctaaaccagagtattgcatgggattaagaaaactcctcgtaatagcggaacgccttcacaatataatcagaggctccttccccatatttagcatctgctatgtttcttacatattcgctggaataggcgttgataagtacattcaaatagggcttgctaagagagacgccgctactattcttctgaataaactggaatatctcctgaacaatagactgtatttccggggaagaaacatctgccgtcaaatcagcagtgagcttcgcatacagtctatcagattgttggccgatttctttaacatcctctgttaattgggtttccgtgatttcagagaagtgttccagattatatctcatggcttcggtatagttctctatacttccaaagtgcttgatggcaagcttagcaacctcggactcatcctctttgactttctggataaacagatcaaagttttcaatgcttccccagtgtttgataatatcatctgtattacggcttttaaaatcctccaatgcgtcgatgtaatcagacaaatcaaattctttaaaactcatgcattgttcccctttctctaagtggctaagaagctggatcagccggtccgtgcgattgcgttttagaagtagcagttccttttgcttcttgaacgcggcaattctgtcaaaatccggtttttgcaatatttcgcgaatctcctttaagcgaaagcctaattctttgaaaaatagaatctgctggagtttctgtaaagcgtcatcatcgtataagcgatagcccgaaggggttaattcacttggctttagcagcccgatttcatcataatattgtaaagcacgtatgctgatacctgttaattccgcaacttggcttatggttttcatttctatcaactcctttgaatatagcatacagtatcacgttacgttggagtcaatagttttttcataatcagggattttctcgaaaagtatttgcaatatgcttagtatttggcttatgcttaatatcaagcatgtccctgggtatcaaaaatataagtgtaaaaatggagggtgttatggaggcttttgaagcagagatcaaaaaggaggagacaggcaggcttacttatgtaaaagtgccttttgacgcaagagcgtgtttttctataccaaaaggaaccatctatgtcgctggaaggattaatgaagttgaatatcgggggaaactgctgtcgcgcggcaagggtgagtacattcttgttttgaacaaggcattgcagaaggcggtaggctttaatggagagcagatgcaggtagaaatcaccatggatttagagcgggaaggcgaaaagaagagtggagataagatcgaaactctggggagcagcatggatgtcataacagcgattaagagccggaaaagtattcgtaagttcacggcaaaagccattgatgataagatgctaaatactctattaaccgcaggcctgcaggcgccttcggcgaagaataaaagaccctgccatattgtcgtagtgaaagataagacaatgcttgcagcgcttgccagttacaacccaaatgccagaatgctggcagatgctgcctgtgcgatgattgtctgcggggatagaaatgcagaagggatgaaagaattcctatatgcggattgtgcggcggtatcgcagaacattctgctgtgcgcccatggtttgggcttgggagccgtatggtgcggcgttgtgatgaattctgattggaagaaacgcattgcaaaggaactgaaatttcctgtaaaagtagaacctatatccgttattgcgctggggtatccaaatgagagtaaagaggaagaggacagatgggatgctggaaaaatccattttgaccgatggtaatgaggccggtattttggaagaaatgaaatagagagcgctccctgccgaatggcagggggcgcttttcggataaaagatacatttaaagtaccggcttggaagcgggcagatccagcgcatccttccatccggcctcggcctctacgcactgagggataagattgatgctaggcgcagtgctggtagcaaaggattcaactcctggaatcatcccttctatggtcactttcagatccggctcgccatagatcgtataactgtcggccattggcggctctggctgtacgtcatggcacactttgtggataaaatggaagccggtaacttctttgccgtctcttaggcatttcataataaattcatgggcagatatggtaccaggcataaccttgccgcaaggaggattcagttccatcttggaggtaaagagccgatgctcttcaacataatcgtcgtattcaatgccgcatcttctggcaatctccatgacagtcggcccgtagtaagaagtgatgatatccttgatcacgtctccattaaaatccttcggatctttcccgtacccaaatacctgcacccatggcgaagtattataggagtcgtcctgtcctcctgtgacgattaatttgtcgatgcgtccggccatagaagatacgacgacaggaagataggagttgaacagtcccgggaagatgccttgctgtatgtaagtcacgccatgttccagcgcgcagttatttaccatatcatataattgcggcgcggtttccttcatgttatagaccggcaaggttgtcagcacgttcttgttggcggacagcgccttgcagatattcctggcgttaggcgtgaagcctgtgggccttagattcccctcatccctcatgttcggaagatagattagcactacatctgcttcttgcttcagcacttcgtcaatatcatcggagacgataacattggccttgtcgaatccaaagatttcccccgcgtcttttccgacctttttcggatcaacgtctacggcgcctaccagttccaggcttttcttggattggatcattttcacggcataacgcccgacgcttcccaatccccatacgattactttgtacttcttcataaataaggctcctttcatgattgtatacgtgtttagtatacgtgtttactaaattctaaaatcatggtatcgcattcatgcagaattgtcaatattaaatggataaggatatattatttttacaaaatatgttaaaatgagtacattataaaggagttttgtcatgaaaaataaacatcagctacaatcagaaaaaacatatcaggcatttatcgatgcaatcatggaaataatcgcaaaaggggatattgagaaatttaccatccgctctctttgcagcagtctgggactgtctcccagaaccttctacctatattttaagaataaagaccatgcgatcctgcagtgctatagcacgcatgaagaggaactgctgaagcagattctggaagcgcagaaggaggccgcagatcctctggacaaggtacttcaaatatttgacgcaaaagtcattgtctccttgaagttcgcaaaactgggaagagagttatacgtctgcgccttgcattattatgatgagaatctgtttgatgataccattccgctctatgtgaaggtaaaagaagccttggacgaatgcgtggagaagaaattgtattcattcaatgaggataccaggacggttgcatgggaactgattgatttttccagggggattgtcttcgactattatctgaggcaggagagttatgatttaaggtctgtttcggcaaaacggatgaaacggtatttggggacgtttatagaaaaataaggatgattgatttcgtgttatagatgagaaaaatataacgcgccatctattccctttttcaataaatggagtgcatgaaatgtgctaagattaatttagagcgggcaagtaataaccattgactcccgcataggacaaacacttcacacagggggaagaagatggaaagaatatactttgacaatggcagcacatcctggccaaaggcgccaaaagtcgcagagtccatggcggaacttctgacgaatggcgcgtttaatatcaaccggggcaactatgaaggcgcatatgaagtggctggaatcgtactggagaccagagagcagctgaagcggctgtttcatgccgcagattcaagaagcgtaatattttccccgggcgttacctattccctgaactactttattcagggattcttaaagagcggggatcatgtaatcgtgaccggaatcgagcacaatgcagtgatgcgccctcttcaccagatggcgagacggggcgtgacgtatgacgttgctcctgcggatgagcaggggaatgtaagcgtagaagagatggagaggctggttaagccgcagacaagggcaatcatcgtctcgcatgcatccaatgtctgcggaaccgtcgtgcctatccgggagattggggatatgtgccgccggaggcatcttatatttgcggtagatacggcacagacagccggcacgcttgatatagacatgcaggaatgcggcattgacttcctggcatttaccgggcataaaggacttctggggccccaggggatcggcgggtttctgatatccgaggaactggaccgccagatgcagccctatattgcaggcggaacagggagccagtcggattccttcgagatgccggataatctgccggacaagtatgagagcgggacgatgaatctgccgggaataattggactgcatgctgcgctgtcttatcttgaagagacggggatagagaagattcacgccaggaagatggaattgacagagtattttctggagaatataaaggaactgccgggaatccggattgccggcaggccagatgtaaggcagcgcgtagccgtggtgtctcttgactttcaggctggcgataacgcagtcgtggcatttgaactggagcagcgggcaggaattatgacgagagtcggccttcactgcgcgcctttggcccatcagacgctgcgtacatttccacagggtacggtgcgattcgcattcagcgcgagcaacaccaaagaggagattgatatttgcattcagacgctgcgtgaacttgtctgatgaagatatagataagatatagataatttaaataagtatggataatgttggaaattaacaatagcccaatccggcaggtttcgttgtccttgataggaaaaaatggtacggtaaatacagtcgaacattgtaaaaatcaaggaggacgataatatggacaataatcacaagatgtggagcgacctgggcatgaatctggaactgcatgaccagttatgcgaagtactgccgcaggcatttggggatgttttcttatcacaggagaacaggccggaaggcatggattactataacatggttgtggcggatatccacggaattcggccatcggaactgatcgagcatcagaacaagggcggaaaggtcttcggaacattctgcgtctatgtgccggatgaggttatatttgcggcggacgcgatcgcgacaggcctgtgcggaggctctcagttctgggttccgggaggagagaaagtgctaccgacgaatacctgtccgctgatcaaggcatccgtcggcgcaagacttgacagaacctgcccattctttaggatcgcagatatgtacatcggagagacgacctgcgatggaaagaagaaggcgtgggagatcttaagcgaggatgtgccagtctatgtgatggatctgccgcagatgaagcgtgcgaaggacatcaaggcatgggctgaggagattgaggctttaaaggaaaaggtagaagagtttaccggaaataaggtgactgctgagaaacttgctgagagcatcaaactgatcaataataagagaaaggctctggagagactctataactgccgcaagagcgataaccttccgatcagcgggacggatgccctggtaatttcccagatcgcgttctacgatgatccggccagattcacgcagatgaccaataagctctgcgatgagctggaacagaggattcaggacgggataagcgtcgttccggcaggtacgaagcgaatcatgcttacgggtacgccgcttgccatcccgaactggaaattacataatatcgtcgagaccagcggcggcgtgatcgtctgtgaagagatgtgcacaggcacgcgctattttgagaaccaggtagatgagaccaaggagacggtggaagagcagatcgaggcaatcgcagagcgctatatgaagatcaactgcgcatgcttcaccccgaacagcggaagaatcgatgatatcctgcgccttgcgaaggaatataaggtggacggcatcattgacgtgaatctgaagttctgcaacctctatgatacggaaggctatctggtagaaagggcgatgaaagaggcaggcattccggtacttggaatcgagacagactatacagacagcgatgcgtcacagcttcgtacaagagtaggagcatttatcgagatgctcaacaacagataataagtaaacaaaaaagaggggattgccagatgcagcaactacagcattatgtgctgtttccaaaccacgacaatggcatgcgtctctataaggaattaaaagcgctgggagtgcgggcggtcatatcccccactcccagaactgccagcaaatgctgcggaatctcgctgatggtggaggaagaagatctggataccatccagtcctgcgccaaagagcgcggcatcgagattctgaagatcgcggcagtggagcgcgacttgaatccgaaaagggaccggtattgctagatatggcggtatcttgacgttatcttgacgggcctgcatatttggagtaatatggacaggactgaatcagaacgggagatatcgctatggaattacagaaaggccgcccggcatcttgggaggggcgggaagaaaaagaaattaaagtatatgatctgctggatcgtcttggcatagaatattttaggacggatcataaggcagcaggcacgatcgcggactgtctggaagtagaccgagtgcttggaatcacgatctgcaagaatctgttcctgtgcaatcggcagaagacagcgttctatctgctgatgatgccaggacataaaaacttgcgcaccaaagaactgtccgcccagatcccaacatccagactgtcctttgcgtccggagaggatatggccaagtacctgaacgtgctgcctggctccgcgacggtcatgggactgatgaatgacacggagaaccatgtgcagctgctggtggatgaagagatattcaaagatgaatatgtaggctgccatccatgcgtgaacacatccagcctgaagatccgtacggaggatgtgtttgggaagtttctggatgcagtgcatcatgactatataaccgtaacactaagcgatgattcccctcaatcttgaggggaattatttttatccatcatgtagaagctgatcatcaggtgcatcatggtctcatagtcttccagtgaggaattagtcaattcctcgatcttgttaattcggtacaggagagtattcctgtggatgtgcagcagttctgccgttttctttgtgtttcccaaatgaagaatataagccttgagcgtatccaggaaatccgtggaatgccgggcatcataatccatgatggccgtaatgaccggagagaggtagttgctctttggcatctgatcgatgcgcggcgtcaggatggcgggcagataataatcctgatagtaatagatccggtatttctgaccgggcctgcggcccagttttagcgcatcctcggcctgaatctggaagtttgatgtatccagcaggtcatagaacaggttgcttaagccgcagtgggcgttgaacttgctcaggatatggttgaactgacgctccgaggcttctgcgtcctgcttaagacttagttcatattgcaggatgtagaggatgttgtgctggatcatcgccagctggtaggggaagaactggaggatggatttgcgtatgtaggaaagcacgttcttctcctgggtggactctgtactgatggcggcaatccggtagggtggagtgggcagatatcccatgtcattggaccacagtttcaactgcctggaggtcttgatccggttgttcatcaactctccgataaacagtttctgataagtataatccatgctgctttcagagtcgcttttaaaaaacaggctgcaggtgtgcatgataagttccatggccttcattcggtccggcgtgatctgctccctggtgcactgcattgtcacgtagccttccacgattccatttaccttgataatgccctggatcttagggtacagcctgttcacctctccccagtcgatcacataaggggcctccatttcatttacggactgcatgatcccttcgttataaagtccgacaaccatatccgtctcataccccttatgttccagaagatagtcccaatagtagtccccggtctttacctgaggagcgatgccaagcaggttgtacatgatatcaacagcaagtacgggaacgcctgtgatgtcattggcaagttccatcagtttctggatattgccgctgggcagcagctgaaacattcgttcataaagttctagaaaatcgattctgtcttccatctgtcacctcctgtttcataagaaaatccattgtaagatatcacaacataaggaaacctataaaagtattatataaaatggaaagaagaaaatccatagaaatccagggtaaattatacaaatatgcaggatgagcaccaggttattcagaaatactgcaaaaaacatacagaggacaaaactttgtgcaactgcctaaaaatctacggcttgtttttgaatgctgcctaatgtacaaggagtaaagtcgttatataattaacaaaaagcaagagacaataaggaggtcgagattatgtttgatttgacaggtaatgttgcggtagttacgggtgcatccgtagggttgggacgccagttcgcactggcattggcgcgtcagggagccgatgtagccattctcgcaagaaggaaagagaaactggcggaggttgcaaaagaggtggaagcgctgggcgtcagatgtcttccggtaggatgcgacgtgacggacgtagcgcaggtacagaatgcggtgcaggcagttctggatgcattcggcaccgtggatattctggtcaataacgcaggaggcggctcctgcatcccgctggaggaacttccggaagaggagtggagaaaggtgctttctctggatctggatggctccttctactgtatgaagcatttcggcaaggtcatgcttgaaaaaggatatggacgggtgatcaatatcgcttcgattctcggaaaaggcggattgaaggaacttcctgttatagcctatgcatcggccaagggcggagtcatcaatatgacgcgccaggcagcgatcgagtgggcgacaaggggagttacggtcaatgctctctgcccaggcttcttcgcatctgagtctaatgggccggaggcaatggagtccatgaacgactttatctgcaaccgaagcgcaatgtgccgcccaggtaaggagggagaactggattcctccatcgtattcctggctgccagggaatccagctatgtgacagcagcgatcctgacctgtgatggaggatggacagcagtctagagtgttaggcgcaaggtcggacaacggcggtttaaaaggaatgtgaaccagattaaaaaagattcagaaaaaggagataaaatatgacagggaaaatgaaaggttatggagttgtagtgccgtttaaggaattcgggccggtggaagccgagattccacagatcgggccattggatgccctggcagagccggtagcgctggcggcctgctcatccgatccgcaccaggtacatgccgggcttccggcaggactgattctgggccatgaggtagcggcaagaatcgtagaggtcggtgcagaagtaaaatgcttcaagccgggggatgtggtagcggtaggcgctgtgacgccggattacctgacaccggaaatccaggacaatctgacccagcatagcggcgggcagaacggcggaatgaactggtgcgtgtttgaaaatggcacctttgcggaatatttccgcatccgtcaggtagacttaaatgcctgcccgataccggaagggctttcttatgaacatgcggttatggcagcggatatgtgtaccaccggattccatggggcggagcttgcgaatattcaattcggagatacggtagtcgtatgcggcatcggcccggtaggacttatggcagtcgcggccagcgcccttcgcggagcgggacggatcattgccatcggcaaccgccagaataccattgacctggctaaagagtatggcgcgacagatatcgtgaagtataaggatggcccgattgacgaccaagtaatcgaactgctgggaggaaagcagccggatgcggtgatcacggcaggcggtaatgcggattcctttgcaagatgcattaatatggtgaagccaaacggctatgtgagcaacttaaatgcgcagacctttgatgcagtgattcccaatgcctatacgttgggcttctgcagccataagcacatcaacggaggcttatgcccgggcggaagaaggcgacttgagagactgttcgcgctgatgacggcaggacgcctggatcctactaagctgatatcccaccggttccatggattcgagcatatccaggatgcgtacgacctgatggcattcaaagaagatcacccggatgtagtgaagccgattgtatttatcgattaatgaaatataaaggatataggagaacgctatgagttacgattataaaaaattatggcagccgattaaaatcaacaatatgcggctgagaaacagaatcatgctgtctgccatgggaacatttacgcctatgcaggacggcacggacagcgaggaaggcatccgctattatgaggagagagccaagggaggcgtgggcctgatcatgacgggcgccatgttcctgaacgagaagacagctcagggtgggcctacccttgcccttcattctacgagagccatcccgaaggctaccgtcatgacggagcggatacatagatggggcgccaaggcctgccttcagcttagctgcggtacaggaagaaacggaatgccggacatcggcgagcgggtgccgatctcgtcttccgccaatccatccttctataacccggagatgatctgccgcccattggagacagaggagatcaaggaaattatgaaggactttgccaatgcggctcagtttgcggtaaatgccggattcgatgcggtagaagtacacgggcatgccgggtatctgatcgatcagttcatatccccgcagtggaattccagaacggatgaatatggcggctcctgggagaaccgggtacgctttgccacggagatcgtagattctatccgcagcgtgacagggccgggatttccgatcatcttccgcatatccctggaccatatgtacaagggcggacgtacccttaaagattcgatgccgattatcgaactgctggaacaggcaggcgtggatgccctggatattgattctggctgttacgagacgatggattatatcttcccgacccgctatactggggaggcgtgcatggcctatgtctgcgaggaggcaaggaagcatgtaaacattccgatcatcaatgccggcaatcattctatggagacggccgtagatctgctggagtccggcaatgcggacatcattagtttcggacgccagctgatcgcggatccggaattcccaaacaagctgaaagaaggacggcgggaagatatccgcccatgccttatctgcaacgaggaatgtatcggacgcattttcggaaggctgacccagctatcctgtacggtcaatatccaggtgtgccaggaaggcgcaacacagattgaaaaacttccgaagccgggcaggaaggtggcggtcatcggcgcaggcccgggcggccttgaggcggccagggtggcagcattgcgtggatgcgacgtgactgtctatgaagcctccgaccggattggcggaacctttggggcgattgcgacggcaccgtttaagaagcggatccgggaactcattacctggtacggcgtgcagttagagaaactgggcgtatccattcggctgaatacgaaggtaacgccagatacgccggcgcttgccgtggcggatgaaatcttcgtggcaacaggctcggttccattcgttccagccatcagcggcatggaagatgagaaggtcatggacgtgacccaggcacatatctgcggcgtgaagggacagaaggtggtgatctgcggcggaggcctctccggatgcgacgctgcgctggaacttgctatggaaggaaaggatgttaccattgtggaaatgatggatgcctgcgccagggatgtcatgagcatcaacaagatcagcattgaccggatgctggatgaatacaaggtcaatatcctgaccagcaccaaagtgacaggaatcacggaagaaggcgtaaaagtagaaaatgcggacggcagttctcagatccttcctgcggagacggtgatcacggcgtttggccagaagccgaacagcgaactggcagagacgattgcagacaagtatccgcttaagacgacgttgattggcgattgccagaaggttgcaaaggccggaaacgcaatccgcgaaggcttttatgcggccatggcgcttcagtaagtccagggagggcattgatatggcgaaagagacgaaatttttcggatataaagcagcagtcggggcctttctggtaatattcgccaacctgggcgcctgtacgacccttggaacctttatcgccacgctggcaaattacagcggccattccgtaggcgcggtcgggcagattgccacagtcaatacgatctgcaatattgtactaagcgtagtggcgttaaaggcgctgggcaagctgggcgccagaaagactatgctgatatccgtaatcgcctgcgcggcgcatatgatattctatacgtttgtcacgccgggggcaaatccccagagcctgatattcatgtatattgcgggagggctggcatcctttgccattacctttggaacccatgcggtatgctcttccgttatcgcagaatggttcgtggagaaacgggcccaggtgactggaatggtgctttccggcgcaggacttggcgcagcagcatgggtattccttgcgggccagctcttcaaagtgacggactataagaactgctatcggatattttcctgcctggtcctggtaatcggattgctggcggtgcttctcctgatcaagagtccggaacagatgggacagaagcctctgggctgggagaaggctgcagcaggcgagacagaggaactgccaggggtatcctacaaggaggcagtaaagtcagggtctttcaaggtgctgatcttagcgcttcttttttctacggtaggcgggtccgcatatctggcctatgcgcctacctggtggcagatgaatggcatgacagccaccaatgcggctaactggaatgccgtgtaccttctgctggcaggattgcttcttctggttgccggcagcatctcgagcaagctggggacgggcggatttgtcatctatgtctgtatggcatttatcctcaccttcgtctgcatggtgctctggcccatcagcggggcgacgtacctgatggtgctgaccgtcatctttgcggcagccgcttatccggtgtgtgccagcataccatccttcgtaggaacggcggccttcgggccaaaagagtttggccagatatcagccacgttgatgatcgcagtatacatcggccaggccatcgcctccccggttatggcgcttctgcttgcgacagaaggcggaatgggccttgcatggaaagtgttcgcagtgacgacggccattggaatggtattgcttcttatggcgcttaagatgtctcctgttaaggagaaaaactaaatttggaggaaataaaatgggatatgaaacgttatttaccccttttaagatagggaaaatggaagtcaagaaccgcctggtcatgtctcctatggggaccaactcggcatttaccaatgggcgcaaggatgcccaggaaatcgattactttattgaaagagccaaaggcggcgtgggaatgatcattatgggatgccagcccttgaatgaagagatcgcacaaggctctatggaaggatacatggactcctttagcgtgcttcctgcgcttacaagcgtctgcgacggcgtgcaccgttatggtgccaagatcgtatgccagttaagctgcggtaccgggcgcaacgcatttccggatacttttggcaatccccccatgtcggcatcggccattccttctgtattcaatcccgatgtaccatgccgggccatgaccaaggaggacattcagaaggtgatggatggattcgcctttgcggcgggcgcggcaagggacgctggatacgatgcggtggagattcacgcccatgccggatatctggtggatcagttcatgtctccggtatggaataagcggacggatgagtacggtggaagcccggagaattgcgcgcggtttccaagagagatcattcgtgccatcagaggcgcagtggggccggatatgccgattctgttccgtatttccctggatcatcgatttgaaggcggccgcacgcttgcggacagtattccgttgctgaagcttctggaggaagaaggggtagacgcgttcgacattgacgcaggctgttatgagacgctggactatatcttcccgccatcctatctgggagaatcctgcatgtcctacgtgacagaagaagccaggaaggcagtgaaagtgccgcttcttaacgccggaactcataacccggatacggcgctggaacttcttgagagcggcaatgtggatctggtgatgatggggcgcgcgctgattgcggatccggaattacctaacaagttgatggaaggccgcagggaagatgtaagaccttgcctgcgctgtaatgaaaattgtatcggccggatctggaaccgtcatacgaaattaggctgctccatcaatgtgcaggccatggaagaagagcgtttccgtctggagaaaacagattctcccaaggaggtcgtagtgatcggcggaggccccggcggtatggaagcggcccgggtggcagcacttattggacataaggtaaccttgctggaacgctcggagaagcttgggggagtcatgggcgagatctgtacagcgaagtttaagaagaatatcaaagaactgaccaaatggtatctggtgcagcttcagaaactgggcgtggatgtgcgtctgaatacggcggccacggcagacgacccgctgctagagacatgcgaccggattatcataggctgcggagcggttccggtagtccctccgattccgggaattgatggaaagaatgttatcagcatcctggatgcgcatcgagatccaaagctgatcaagggagatcatatcgccgtatgcggcggcggagcatccgggtgcgatggcgcgctggagatcgcggaagaaatgggcaagaaggtaaccatcatagagatgcttccggaatgcgcgaaagatgccatgtttatcaataagatatccttgtttaacgcattaaaccgtaatcatgtagagatgcttacagataccaaggtagtctctgtgcaggcagacggcctgacgctggagaagaaagacggaactttggaaacgctgaaagcagacacggtcatcactgcatttggcatgaagccggaccttacgacggtggatgccatcaaggccaaataccatacgaagacgagagtcgttggggatagcaataagccgggaaaaatcggcgatgcagtgcgggatggcttctatgcggcatccagcctgtaagatacggtagtgacttacaagaatggaggaaagttataatgaaaaattattttgacctgacaggaaaatatgcactggtagccggagcgtcttccggcattggaacccaatatgccaaagcgctggccagccagggtgcggcagtggcagttgcggcaaggcggaaggaacgcctggaagaactgaaggcagagattgaaggcatgggcggaacctgtatcgccgtagcatgcgacgtgtccgatgaagacagtgtaaaagcctgtgtggcagaggtggaaaaggcctttgggcgaattgatatcctggtgaacaatgcaggcatcaatatcataaatgagtttagcgaattttcaacggaagactgggataaggtagtcaatatcaatcttcgcgggcaatttatcatgagccgggaagtatgcaagctgatgaagaagcagaattatggaaagattatcaatacggcatccgtaggcggctacgcaggcggcgcttcccagattgcctattatgcgtccaaaggcggcgtggtgaacttcacccgagcgctggcttctgaactggcgccttatcatgtgacggtcaatgccatcgggccaggcgtattcgatacagagatgacccacgactctctggatggagactttgccaagtatctggaaggccgcgtgccacttggaagatggggaaaagatggggaactggatggtgcgctgatctactttgcctccgacgcatccagctactgcacaggccagacgctgtatgtggatggcggcatggtctgcgtgctatagacacgcactggcgcgaacaaaaagaatctgtatattgaatcccttacggggcgggcgatccttggattgcccgcttcttttgctatccaaggctgtctttttgtgaatggccatgatataatttgataaatcgggtttaactattgtaccaggaggcatatcatgaatagcaaccaattatggcaatttaagacgattgcggagtgtggaaacattaccaaagcggcagaattgctttttataacgcagcctgccttaagcacggcgctgggcaaactggaggacgaacttgggcggccgctgtttataagggaagggaggaatctttccctgaccgaggatggcaaagtgctgcttcattatgcgcggattgtcaccgatgccattgaccgggcgcaggagcatttccgagcgaagaatgagacccagtccatcaatctgtaccgtatcggcggcattgctgcaaacctgctgacggaaggctgttttaatattgaagggtgcaggctgaacggcatattggtatccaacaaggatctggcaaggatatcgacatccggcatagccgatctgattatagcggacgacagatatatgaacagtgtgacgcacaaatatgaggagaaggaacttctttatcatcagcagctgattctatccgtaagaaaagaagatccgctggccagattcgaccagctggatgtacaggatatccagggactgtctatgctggggcatgtcaatccgctgggatttgcgtcctggatatctgagatcaagcgggacaatcgctgtgattttgttgaagaggtggcgcttgataatatgacctattttgcggagcgggacagacttccgtggccggtattcatgagttcctttgggatagggacggaaagaggccgggattatttttcccgcagaaagagcatcaaggtcaacggaacatatacgcagagggatatttacctgtggtacagccggaagaacggcaagaatctgaaaccaatggttgacaagataaaggagaatgccgcaaggatattggagatggaccgcaagtcagggtttttgtaagggagaattgtaaaaggactcggctaatggactggcggatctataattttgcggcgaggctacatagaggaagagaaatgagtataaagattatgtcggcagaagaagccgtaaggatggtagaatctcaaaagacgctgtgctgcgagggatttgtaggagccgcgcttgcggaggaacttctgatagaacttagaaaccgctatctggaaacaggaagccccaggaatctgacgcttttatatgcggcaggccagggagatggaaaagagcggggattgaatcacctcggagaggaagggctgcttaaaagaacggtaggcggacattggaatctggcaggaaggctgcagaaactggcgctggaagagcggatggaggcttacaacattccccagggagtgatagcccagatgtaccgggatattgcagcaggaaggccgaccatatcccgtatagggctacagacatttgtagatccaagggttgacggaggcaggctgaacagcgttacagaagaagaaatcgttcatttgctggagattgacggagaagaatatctgaaatacgaccatcttcgtctggattatgcatttatccggggaacttatgcggacgagcggggcaatatttctatggaaaaagaatgctgcgacctgggagtgcttgctatcgcggaggcagtgaaaaactgcggaggaaccgtattcgtccaggtagaaaaggtagtgaagaccgggacgctggatccccgctatgtgcggattcccggcatgctggtggacgtcgtggttccggtgaaggatcagaagaatcatatgcagaccttccacacccagtatgaacccgcattttccggtaaagcggctgtgtccggggaagaacaggatactcttgcggcaggcgtccgcaggctgatcggaaggcgatgcgccctggaacttgctaaggatactaccgtgaacttggggatcgggatgtcggagattgtaggggcagtggcctgggaggaaggaattggacaggagatgacctttacgatagagggagggccagtcgggggaattgccatgtcaggcatggattttggagcaatggcagggccaacgtgtattatagaccaggcatccatgtttgatttctatgacggcggcggcttggacgaagcatttttgggaatggcggaatgcgaccgccttggaaatatcaatgtcagcaagtttggcttaagaatcgcgggcgctggaggattcatcaatatcagccagacgtccagaaaggtcgtgttctgtggcacgttcacagccaaaggactggaagtggaggccagggatggaaggcttataatccaaagggaagggcagatcaataagtttgtgaagaaggtgcatcatatgaccttcaatagcgggctggcaagaaagcgaaagcaggaaatactgtatattaccgaacgtgccgtattcgagatgacgcaggaaggaatcatgctgacggagattgcccccggtattgatcttcagaaggacgtgcttgatcatatcgagtttgcgtgtgcggtgaaaacggatctaaaacggatggatgagcgcattttccgtgaagagaagatggggataagactggattgaaaggaagagtgcattaaagaggataccaaaaataaaatttatgcttcgataaattttagaaagtgttatttttcctggagttatggtactgtttaacaagagtgtttaagaaatctatggaggatattgaatatgcagttaatgaaaagtttccgcgagtatgtagaaaaactggaagcgtgtggagagatcgttccggttacgaaggaggtggactggaatctggagatgagcgccatcacaaggcatgcctatgaccttccatccgcggcgccgctctttaagaatatcaaggattgcacgccggggttcgaagtattgggagcgccggtgggcttaagcccggataaggagcatccattcaaacgagtggccctctcccttggacttcccattgatacttccgcgccgggaatcgtaaaggcctggtcagaacttgcggatgttacgcccatcccgccacgcgaagttgagacgggcgcatgcaaggaaaataaactgttcggcaaggatgttgacttgacgaagcttccggttccgttgatccattacggagacggaggccgctacatcaatacctatggcatcttcatcgcccgcacgcccgacggatcctgggtaaactgggcgatatccagggcaatgcttgacggcccgcagacgatcgcgggagtcgtgattccgacgcaggactttggcaagatctatgccgagtggaagaagatcggcaaggagatgcctttcgcgttgtgcctgggcgtagatccggccatcgccatgatcgcgggctacccccttccttcccgtatcagcgaaggagaggtgatcggcggctggtatggcgagccagtggatgtagtaaagtgtgagacgaatgacctgctggtaccggcatccagcgagattgtcatagaaggatttgcatcccttgaccatatggttccggaagggccgatgggtgaatacggcggatatgtttggtccgggaagaataagccggttccgtgttttgacgtgactgccatgacctaccgggacaacccgatcatgccgctatgcgtggccggcgtgccgaccgaagaaaaccatacaaactggggaatcagcattgccgccagcatccagaacgtgctggataagaagggatttccgatcaaggaatgctttattcctatggaatcggcagcacactggtttgtagtttccgtagaccgcagcagggaaaatgaagacgatgaagaactggcgctcgagattggcaaggcagtcttcgcgtcaaaaggaggctcctatattccgaaagtgatcgttgtggatgacgatatcgacccaagcaatatcaatcaggtcgtatgggctctggcaacccgccatcacccggaccgaagggtagccataccggatcagtacatcttcccgcttgtggcatacttaagcgcagaggagaaaagcgaggcagtgtccacaagggtcatctataactgcctgacccctttccacaaatggccaaaagaacgccagcctgtagaagcgtcattcagaggctatccgaaggaactgcaggaacaggtattgaagaattgggaagagtatggatttaagaaggactagatcacaagcattatggagagaaaaggcatgagaatcattgtaggagtatccggggccagcggcgtggagatgagttattacttgctgaaggctttgaaaagcatagagaattgcgaggtgcatctgattctgagccagggggcgaagacgacttggaaactggaaagcgacattcctgtggaagaactgctgaaactggcagactgcgtacatgacgagcataatctggcagcatgcatatccagcggctcctttgttacggatggcatgattatcatgccatgcagtatgaagacgctggccgggatagccacaggctatgcagataatctgaccgtccgggcagcggatgtatgtatgaaggagggccggaaggtagtgctggttccaagagagatgccgttcggaaaggtgcacatcaggaacatgaaagaggcgtcagacttaggctgcgtgatcgttccgccggtactgacattttacaatggagcaaggacgctggaggaccagatctgccacatcgtggggaaggtgctgctgcagtttggaattgcctatgacaagtttgtgccatggacaggggcaggagaagaatgttaagagaagaattgtttgatggatattcggtatactgtgacgtcattcccatgggaaaggattacacgctggccgtctacgggggagatactccccacgtaggcagcgtggtgctatcaatagcaagacctagccttgccggagagggcatcggggtgacatcctcggtgctgtctggcgtgggacataaggatgaggccatcgcacggctgttcgcggaagccttggcaaaggagcggtactgtacggtggcctgctcctgcggcatccatgtggatgatattacgcccggacagatagaggcagtccgggaggcctgtgaccggctgctcggccgactgcttaagcagacgagaacgcctaaggaagagcagtagccagccggtattctgaatttacctctacggctaccgcgtccgacctgccagtctgacatatttcatatacgctatccagtgtccattgctgccgtttctggcagctttgttcatttccggaccagtctggcacaagcaagtctttttcaggattttataaggaaatagaaaataaaaaatgtatttgacaaacatactgtcggtatgtataatgaacttaccatccacatacaggagggagccatggcaagaaataaatatccggaagagacaaaaaaattaatcgttgatacagccgccagactatttatggagaaaggatatgaccatacgtctatccaggatatcattgacaatctgggcggtctcacgaaaggagccatctaccaccatttcaaatccaaagaagacatcgtgtacgcggtttttgagaagatgtacgcacaggcagacatagatacgaagaaggtctgcgagagtaaaaatatgaatggctttcagaagttacaggaagtcttcagattatccatcttcaatccggcgcagaacgatgtgctcgtggtagcgattgatatgatcaagaatccgcagctgctagtcatctatctgcgcgatatggtgcagacagagtcgacagagatggtgaggcgtattcttgaagaagggatagaagatgggtctataaagaccgagtaccccaaggaactggcagaggtattgatgctgctgggaggaatatggatcaatccaatggtttatcattgcgattcgtcagaaatcgtgaaaaaggtaagattctaccagcatatgctggaggcgcttggccttaatattattgaagattcatggattgaccagatagaatcatacgccgcattgtatcaggagaatcaaaagtaagaaaaactgtcctgtttttacagggcagtaaaattttaaaattatacataccaacggttggtattaaaaggagataagtcgtgattaaagtaaaaagggcaggaaaaaactttggaaacagatcggtaataaatgactgttccctgacaattgacaaaggcgagatctatgcgctagtcggcgttaatgggacaggaaagaccactttgatgaagatggcagcaggatttttacagccctctatgggagaaatctatgtagagggagcatcggcctgggagaacaaggagaacatacagaggctgatcggcagtctgatcgaggttccggtgttctatgagcacctgtcagcaggagagaatctaaggctgcatcaggcctatatgggctgtcaggaagacatatccgccatgctttgcacggtgggtctgtcagagaattatgataagccggtggcgaaatattcgatgggaatgaggcagaggctggcgatcgcaagagccatgcttcacaagccggatatcctgatcctggatgaacctttgaacgggctggaccctgtggcagtagaagatatgagagtgctgctgagaaaaaaggcggataaaggagtagcaattctgatttccagccacatcttaagcgatgtgctgcaaattgcagatagagttggcgtactgtcggaaggcaggataaaaaaggagtttgtcatgcaggaatataaagagcagagtttagagacgttcagtcaggaagttctgggaatcatgaagggagaagcgtaatgaagatatgggagctggaatggaaaaagatcaataaaaagccttttttgcgggggatcataggattggcagcattcagcctgtctatcgcaatgctctttctgtttatgccggacgaagagatgggcagaggagacgccatgatcatcagggagtgggaaagcctgatcgtcctggtatcctgcgttacgttgtttggatttgcggtgcttggggcagtcatctatgtgaatgcggtttttaaggaatatcaaggcaagcgctcgcttcttttgttctcctatcccatagagagaaaaaggatgttcagggcaaaggcctgcctgtcaggcgtaagtatcatggcagcggcttttatcgtaaactatctggtgcttttggtagcggggcttacatcgaatgtatttcatattatgccgcattcttttggattaaaagagatggtagaacttgtcgcctacagtcttgcgatggcggtccttgcaagcggcataggcctgatcgcccttggaatcggcatgttcagatcctcggctatgacggtcgttatagcgactctgattatcgctggagtgatgaccaatctgttttccgcaaatatgtttaccagaatcggcatcgcgatagcgctggttcttgtattggcggcaggctgcgtcgcatttcatcagatggaagtcaggattaagaatatggaggttaggtaaatgcatcagaaaaagggctattcaaaggatttttacctggtcgttatcggccagatcatttcactgtttggaaatgcggttatgcggttcgcgctgcccatacatctgctgaacgtaacgggatcagcggctgtcttaggcgtggtgtccggatgcgcatttattcctctggcggtgatgtcaccgatcggcggaatcatagcggatcgagtgaataagcggaatgtaatggtatttctggattttttcacttctgggctgaccgttctattcttgcttctgtatgggaaggtaagcattacaggaatggtgctggtgacgctattcttgctgtatggaatcagcggggcatatcagccttccgtccaggcaagtattccggtattggtggagtcggagcatattatgccagcgaatgctgttatcaatatggtatcttccttatccggcctgctgggtcctgcgcttggcggcacggcgtatagcctgtggggaatctatccagtgctgtccattgccgcggggtgctttttcttatcggcggtgatggagatattcattaagattccatatgagaggaagcaaagcacagaatccatcctgcgtcagacgaaagatgatctgtgcgagagtattgcctatatcggccagaaaaagccggaacttgcaaaactgacgctttgctgcgcgggcgtgaacctggtcatgtctgcgctgatgatcatcggcctgccggttatcgtgatgaatatccttgacttttccaagtctgaggcatccaggctatatggatacatggaggcgattcttgcaatcggcggcctggttggagggattggcgcaggcgtctttggacgaaagttaaaagtcaacggaagctggaagcttctccttgcttcaggaatgcttctaatccccatgggggtcgtgcttatgatagagtgtccggcgtatctggcatatggggtgcttgcagctgcggggcttgtcattatgtctctttccgccatctataccatacagattatgtcttatatccagatgaccgtgccacatcatatggttggcaaggtcatcgcatggattatcgcggtgtctacatgtgcccagccggtggggcaggttctgtatggagtcctgtttgatgagatggcgaagaacgtatatatcatttttggcgctgctactatttgctcggtgcttatcgcgctaggaagccggaaggcgacgaaggcgttatgatgcgtttttagatagagcaggaaacttagttaaaatatattgtacattcatcttgaattgattatactgagaatattgaagttagagtagattcggaaggttgcgaggagagataaaggatgttttttttctttgatgttaatgagtataatgatgggataccaggatatgagcaaatgatgaagccaatccttgcagcattagtggagttaggtgggaaaggaaccgttgcggaaatcgataggaaggcaagcgagttaatgaatctgccggaagatattttgaagattatgcataaaggttctacaaccagaagcgaagtagcttatcggatggcctgggccagaacgtatttgaagagttatggcttgatcgagaataaaaagagaggattttggtccgttacagaaaattttgatggagatattgaaaatattgatccttctgaaattgtaagaaaacttcaaaacgagaaagagcaggtcaataagggagaaagaagtttagaattcgaatctgcaaaggcgtttgaaaatctgagtatatccttgcttaaggatataacattatcagaaggaaagaggatatcaatcaatgcaatagccaatgaatccccatttgatttgtacttgccagatggcatagatgattatagtggtcacttgaattgtgcgattaaatttgaagcagaggggaaacgtcatagtttatcaatattgcaagagtattgtgaagaacttagagcaggcttaaaagaacagagattattgcttataacaaatcttattattccggaagagtttagaaataaatacagggatatgatatttttttgggataaggaagatttagaagaacgaatagatccagaagcatcatatgcaggctatctaatcaatccccagaagactttcatagaagaaatcgtatcgttagatgtttccagggaagaacgagataaagaaaaggaaaactatatcaaaagagtttcaactgcttttaaaagcggagacatggtcctttttctcggagcgggaatttctattgatggaggcataccattatgggatacattgataaagcggttacatatccatatgataaatagattgaacaaggattggacattaaatgcaaaagaacaagaaataatgaaggggctagcctttagtaacgaaatggattctcctttattacaaatgcgatacataaagtcagcattttcgaatgatgaatattataagctagtacattctgtgctctatgaaagtaagactaatattgatacaaaattgttaagtgctatagccaagatctgtactccgcaaaggtcatactgtggtgtgaaaaatattattacttataattttgatgacctgctagagagaaaatttgacgaaagggacattagatataatgatatatcctgtgaagaagacagacaggtagtggataaattgaatatatatcatgtacatggctatctgcctaataatatgaaaaaactaaaaggagagccggaactgatattttccgaggaagattaccatagagtgtatcgggatgcatattcatggtctaatctaattcaattgaatgccttacgtgaaaatacttgcttatttattggatgttcattaacggatcctaatcttagaagactgttggacgtggcaacaagaaaggaagagatgcccagacattttgcaattttaaaaagaaacgagattaaaaataataatctcgttagcaagtctgatcgggaactccttgaaatatatcaaaggatagataataatatccaagtgggttattatcaagaattaggacttaatattatatggatagatgattatagcgagattcctgaaatacttgaaagaataattgaatgaatattattcattgacggtcagattcttttctgctatactgtctgcaagatcaaaggaggcgataggcaatgccacgaatcacaaaggaaccggcggagcgcagacaggagattatagatacggccatgaggctattctatgaaaagggatatgaaaggacgtcgattacagatatagcgagggagatgggtgtggcccagggactttgctaccgatattttgcgtcaaaagaaagcatctttgacactgcgctggaacagtacgcggatatgcaggtagctcaattgtcacggggaatgctggattctgggcgttcccttaagcagatgatcgcagagatgccgaccttcctggatgtagagacggatgataatttctattataaattttgccatgaagccggaggcataaagacgcaccagcagttgtccatgaagatctgcgagaagatgatgcctattgtagcgcaaatgctggagcgggcggttgaaagaggcgagatagggccttgcgatacccggacagccgcttctttctgcgtatatggccagctgggcattctgctggaccgtatggtcgacggagaagaacgggtccgaaggattaagacatttttgcttggcatgctggatatagcaaagtagttttccctgccgttaggggcagggattctttaaacaacaataatgaatgatattcattcaatggaaggaaagagaattatggaaacaaaaatggattttgtaaatgagagcacaggcagatgcttctggatgatgttcctgccggtcatggcggctatgtttctgaatatggcatataacgtggttgacagtttgtggatcgggaatctgctgggggagagggcctatgcggcactgaccagttcgacaccggttattttgatcttaaattcgattgccatgggagccaccaatggtgttgcaatcctggtatcgcaggcaatcggggcgaaggaccgtaaaagggcggacgggattattgcgacttcgcttatcgttgcagtggcgtttgccctattggtgacgatcctgctggaactgtctctgccgatggtccttcatgtactgaatacgccaaaagagacctggcaactggcaaaagaatatctgtctatctatcttttgggatatattgcggtatatctgtactgctatcttacagcggtgctcagaagtttcggcaatgcggtcttccagatggctgcaatgctagtctgtaccatgttaaatgccatcctggatcctttgttcattcggcgaatgggatttcggggagcagccatcgccacgttactgtcccagacgatctgcctggcgttcatggtgatctatatgtataggaaaaaagtaatacggctctatatccaggaatttcgtaagggattgatcggggagattattgccaaggcagtcccttccgtaatccagcagagcatcccggccatcagcacagcgtttctgacatcgctggtaagcagcatgggcctttgtgcgatagcggcctacgggataacgggaaaactggagattatcctgttctatccggcgatggcaatcaatatggtgctgacgaatatcatcggacaatgcgccggagcaaaaagaagcgaccgggaaaaggagtatctcatatatgccctgaagatggggggaattctgctactacttttgtctgtcggagtagtgggatttgcgcgtccgctgtcgggactatttttaagaagcgaagatgtcgcgggaatcgttgcgggatatttcctgattgtcggcgcaggctatgtgctgaatacggtaacgaactgtttcctaggggcgttaaatggactgggaagaccttttaaaagtatgatgctcatggtattttactatattcttgtcagaatgccgctggcttggatcctcaatcatgcaggatgggggcttgatggaatctggacggcagtgctgatcagccatatcgttgcaagcatagctgctttttatgcaggatacacagaaatacgcaaagaagcaggggcgagtgccattattgattgaacgagactagaaaaggggtgggaagatagtgtcctactcctttttggctatgttgaacaaaaatatcaggatttatttgtaaaattgttagaattgacaaaccatggatatatgcgtatcataatgttaaataatatttataaacactatttagaaataatatttaaaatcagaaaagaaaaaggagaagacaatatggcaaagaaattatttacgacgatctatggacgcaacctggtgggagaacttaagaacatcgtgcagaggccatacctggtggtgacgatggaggacttatgggaccggttcaaggacgagttcgatgacgactgcatcgtgcacttcgtgaagacgctggagtacgacgagatcatggcggaggtggagaggcttccgaagttcgaggcggtcataggccttggcggaggccaggcggtggactatgccaagatggcggcgtggaagacccatatgccgctttaccaggtgccgacctccatcgcgaccaacgcggtgttcgggcatcgcgcgggggtacgcttcgacagcgtggtaagatacgtgggttacgtggagccggtagcggtctatgtggactacgacatcatccagaacggcccgaaggacctgaaccgcagcggcgtgtgcgacgtgctctgctacaacaactccatgttcgactggaagtatgcggcggaccaggggaaatgcgaggagaagtggccctatgacgaggagatggtggcagaggtcaaggaggtgtacgactccgtggtgaacggcctggatgacatctacgagctgaacgagaaggggatccgcaccctgacggaggggctgagatggggcggcggggcgttccacaacaatggctggaacccgaggccgatcgagggaagcgaccacttcctgttctacacgctggaatacatgacgaagaagaagttcatccacggccagccggtatgcctggggatcttcgtgggctccgcgatgggcgggaacgacccggacgggatcctggacctcatccaccgcgcgggagtggagatccgcccggagggaatggggatcacatgggacgacgtgttcgcggcgatcaagtacgagaaggagttcctggagagcaacggatactggtatacggtggtcaacgactttgaggtgacggaggaattctgccagatgatcaaggaaaaggtgatcgccaagtacggcgagtgggatcaataataagatgcagaaacggccagaggtgcgcagatgaaagtatacatagtaaaagattatcatgagatgagtaaaaaggcggcgtccattattgccgtacaggcagccatggacccagacagcgttctgggcctggctacaggctctaccccggtaggtgcctatgaatatctaaggaaatggtctgaggaaggaacccttgatttttcaggcattcgtaccgtgaatctggatgaatataaagggatagcaaaggaaagcgaccaaagctattatcattttatgcgggagaatctattcgatcatatcaatgtcaaagaagaaaatacctacattcccgatggagaaaaagaggatatcgatgctgtgtgcagagactacgaagcgttgatccggaaacttggcggcgtagatctccagcttctggggatcgggagaaatgggcatattggatttaatgaaccttcggagacgttcccgggagaatgccactgcgtagatcttgcagagagcaccatcgaagccaacaaaagattcttcgaaagcgccgaggatgttccgagacaggcttacacaatgggaatcggaaccatcatgaatgcaaagaaaatcctgctgctcgcaagcggagaagataaggcagaggctatgtaccagacgatgtgcggccctatcacgccacgggtgccagcatccgtgctgcggcttcaccgggatgtaacaatcattgccgacgaggcagctatggcaaaagcagggacaagataatcttgatgaaacaggagggagaggtcagcatgacgacattggaaaaagataaaaaatatttgatacagtgctatacaacggatgatattgtatttaccaaaggcaagggtatgtatatgtacgacgaagacggaaaaaagtacctggatttctcaggccagttctccgcatgcacccttggacatggaaatgaagaaatgattgaagccttaaaagatcagcttgagaaactagtgtcagtgacttcctgttttgcgacagaagaaagagcggccctggcggaaaagatgatcgagatatctccggaaggcctggacaaggttatgttcggctgtaccggatctgacgcaaacgagtttgcgctaaaactggcaaaatattaccgcggaggcggaagaatcatatcttttagaagaggattccatggctctacggcaggggcggctgcggcaaccggaaagtcggagatgatccaggagaactcgggaatatcggaactgcttccaaggggatttgtccactcagccccgccttactgctaccattgtgattttggcaaagagccgggcagctgcggcctccagtgcctgaagtatctggagcagactatgctccatgagggcggagataagatcgcggcagtcatatcagagcctatctttgcggctggcggcgttatcgtgccgccgaagggattctggaaaggtgtaagagaattgtgcgataagtacggcgcgcttctcatttttgatgaggtagtaaccggaatcggacagacaggaaccatgtttgcctgtcaatatgaagacgtgaccccggatatcctggtaacgggaaaagggcttaccagcggctatgttcctggctcggccgtactctgccgcaaggagatcggcgaggcgatgagcaagatcagccttcacggacatacgcattcctgctatccgatgacctgccgcagcgctttgaagaatatagagattattgagagagagggacttgtagaaaatagccgcctagtgggagcgtatctgcatgagaggcttctgggcttaaaagacaagtatgaggtgataaaggatgtacgaggtcgcggacttcttcaagggattgagatagaaggaagcgagaaggcggacaaatatgtgctgggccaggagttctatgagactatgctaagaaacggcctgattacagaactggagagccggaagaatctggagaacgttgtcgttgtcatgcatcctgccttgatcacatccagggaaaatgtggatgaagcagttgaaattattgacaaatctctttcggcttgtatacaataatctaataaattcagagggagattcataacgctatgacgagagaaaagaaacaggttttgacggtaaagaatatcagaaatgtcaatatggaaaatattctccaatctatccttagaaaacgggagactacgagaagcgtcctttctaaagagaataatatcagccttatgacggtaaagcatgtggtagatgacctgatcgaggccaaaatcctgctggaaaaagattcctgtaactcggatgtggggagaaaccccaaggtgcttgagattgcagagaactacgggaatatcgtgtgcgtgaatctcacctcgaaagacgagatcagcttcctgatatatgatatctatgagaatcttctgaaagagcagagcatactgctgcatcaagataggccttatcgggaagaactggccgcggcaatagcggccatccaggcagaactaaaaaccataccatcgctgaccgtcggcgtggcagtatttgtgccaagtgcatacgatgccagcgtggacctggtgaattatgatttgataccggagtttaaagaactgcatatcagatcattgtttgaagagaaatttgaaattaataatatattgatacttcatgatgtatttgcagcggcaagatcagagtatgatagtctgaatcccaagatggagagccagttttatttctattgcggctatggcgtaggcggctttttcattcataaggatgaggcggttgccggcgccaggaatatggcaggagaagtaggaaaaatgctcgtatctatggatggaagagaggcggcatatgcaacactggaagaattcgtatccatctctgcggtaaagcagaagatgaaggaagcgggaatggaaggcagttttgacgaactgctgatacagtatcaggcaggagataaaagggcaggagaaatatttgacccagtgctaaatacaatatgccgtgttctatacaatcttctatgggtatacaatcctaccaggatcgtaattgacagttgcaaaagtgattacagccaagtaattacagaacattttgaacagtttatggaaagtatgaagaatgacgcgattcccatacatgtggaggcaaggaccgcaaaatatgatgaataccatatgatgcgcggctgcttctacatggccagaaatgcatggatcgaggggatagccgactccatatagcaggctgattgcatcggaaagtaggaatggagtaatatggaaagcgtaattattggaattgaccttgggggaaccaatctgcggattggagcggtaacgccggataacagaatgctggctccaagagtaatgaaaagttcgattgtggcggatgcaaagaatccaattggaaagatctgcgagattatcacaggctatatagagcagaatcagctcgagaatgtggaagcaatctctataggggttccttcctccgtggagaatgacaaggaaacggtgatctgcaccactaatatacgaaatcgggcgggagaagttgtattttcccatacgaatatggcaaaggacgtcagggagcatttccagattcccgtatttatcaacaacgatgtaaataatatcatgctgtatgatattgccgccaaccagctggaagagaaaaaggtggtagtaggaatctatatcggaacaggagtgggcgcgtcggtggtgatagatggaaagcctctggaaggaaagaacggggcggaacttgacattgggcatatgccttacttccagggcgaggtggaatgcagctgtggaaagaagggatgctgcgaatgctacgcttctggctggagacttcaggaaatccgaaaaaaatattacccggatacagacattaaagatatgtttacgcagcacaaggatgaacgcccgcttaaggaattcatccaggcgtgcgcgaatatatacgcggtcatggctactatatttaatccggacaccatgattgtaggaggcggcgtgccggagatgaaggactttcccaaggaagaatttgaaagagaagtaaacaagaatacaggaacggatgtcatgtattatggattcgattatctgtattcgagagaattcgtaggaaaaggagtgatcggcgcggccgtgtttgcaagaaggaaattaagacctatataaagtacgatgcggagaggctatgaagtctctccgctttgcatatcaccggcagccccgggcatagaggaatcccgccctaaaggttgtgcaatctggccatttgtcttataatagatgcgattactagaatgaaggattggtaaaaggtacgaatgatgaatagaaaaataatgaaaaaggcagcaaagcgcagcctaaagaagcactattggatattcctggctgcgtgcctgatcgcggcttttctgaatgtggaattttctgggactctaggttttgcacaggtgaatgtaaagccggcccaagaggcagaagaaagtccatcttccgggaacaccgcgcttcagcaggcaggcgcgtgggatgttatgaatgatatcctcagcggcaatgagaaggaaggaaagcagctgtccgagcagatcaggcaggcgcagattcagcagtccgggcaagcgaatcccgcatttggcaggagcagaggcgtgctggcccaggcggtgaactctattacatccggctctttatttgtaaccatcgcgtctgcggtcaatggaatggtgaagtcaaaagaggcggcgcttctgatcctgattggccttagcatgacattgatgctgggcttctggttctttgttaccaatgtatatatggtgatttccagaaggatatttctggaggggcgtaattttgagatcgtgccgatccagcgtttcctttttctgttccgcgtgcggaaatggacgaaggcggcatggaccatgctggtcaaatacatatatgagtttttgtggtcattgacggttattggagggatcatcaagcattattcttattacatggtgccatatattgtggcagagaatccggatatttccgcaaagaacgcaatccggctgtccaggaagatgatgaatgggcataagtgggaatgctttgtatttgaactgtcatttcttggatggagtatgctgggagcagttacgatggggctgtcacaggtgctgtattccaatccatacagggtggcatcttttacagagtattatgttgcccttagaaaaatggccaaagaacggaacataccggaggcgcagcagttaaatgatatctatctgtatcggcccgccgggagggaagcactggatcttgcatatgctgatgtgattgcggtgatgaaaaagccaaagaaggagatagacgacctgaaaggcatccgcaagttctttgcggactatttgggcatcctgctgttcccaagcgcaaaagagagagagtatgagaaggatcaggcagagcggaccaggatctttgccctgcaaagagcggtagaagggaagtgctaccccagccgcctggatccgattccagagatggcgaagcggcagaaggtagaaacagttcattatatgcgtcattatacggtgtggtccctgatactattattctttatattttcctgtatcggatgggtatgggaagtaagtcttcatctggtaaatgacggcgaatttgtcaaccgcggagtcctccatggcccatggcttccgatatatggaagtggcggcgttctgatccttaccgtgctcaataagtttcgtaagaacccggcggcagaatttgtggcgatcgtcgtattgtgcggagtggtggaatattttacttcttattatctggaagtgacccagggaaagaaatggtgggattatagcggatatttcctgaacctgaatggacgcatctgcgcggaagggctgctggtatttggcgtaggaggcatggctattgtatatgcgctggcccctgtcctggataactttatacggagacagaagctaaaggtagtgcttcctgcctgtctggtacttctgggagcctatataggagatgccgcatattcgtcggaacatcccaatgcggggaaagggatcacggactatcaaagcagggatgtaagacttgacatgtatgccaataaatgataagatgcaagtgatcacttgcaaggagattgaatatgcttgacgatacccaggaaaagattattaaagcgacgatggaactggtgatggaaaaaggatattccaataccacgacgaaagatattgcccgaagcgccgggatcaatgaatgtacgattttccgcaaattcaagggtaagaaggaagtcattctggcagcgatggaaaagccggagtggaatccggatttaaagccagaagactttgaaggatactcgggagatatgctggaagatcttactcgtttttccaaagtttatatgcagaaggtaacgccccgaatggtaaaggtatctatcgggcttcgtacgcctgaattatatccttatactgccaaaggaatcttgaagattccccagaccttcaagaaggcattaaaagaatattttgtggagatgaaggaacaaggaaagatccggcgggcagatccggaggaactggcaatgctgttcttgtctatgaattttgggttcgtatttttgaaggcatctttcggctctgaactttcaccgatcgaaagtgcagcgtatatcgaaagtagcataaacacttttgtaaaagggattctatagagaaccattattatggcactgaaaggtgccatatatttttaatatgaatgcaagcgtatacttgcatagaaaggagaacgacttgacttattttgttgtaagcgtgcagatagatgaagagaaggggatcggaagttatgaggattatatccgacaggtaaagcctttggtagaactgcatggcgggaaatatctcgtacgctcggagaagatacaatacctgggaaatgtctggaagccggatcgcctgattatcatctgttttccctcaaggaaagagttggatgcatgtttccaatcagaagcgtatcaggaaattgcggacaagagaagagcgtgggttgatgcccaggcggtgatcatagaggaggagatctatggagatttgtaatcatgtgcaccagattcgaattgattttaatgtgacggaagatgtaaagcggtatgtgtatgtatatctgctaaccggaagttcctgttttctgattgatgccggggttgcaggcgccagccgggagattgaaaattatatggaaacgattggaaggcggctggaagaaatagaaggcatctttcttacccactcccatcccgatcatatcggaggcgcgttagaaatccaggaactggcccactgcaagatttacgcaggcgcaagggagcgagattggatggaagatatagaccgtcagtttgcagaacgcccgattcctaatttttataaactggtcaatgcttcggtaaagatcgataagatcttggccgaaggcgagactatcgtgctggaagaaggcatgaccttaagcgcggcggaagttccgggccattcgagggggtctatggcgtattgcctggataaggggaaagttaaagtgctttttacgggggattccattcctgcaaaaggcgatctgcctatatttacggacagcggcaagagtaaagagacgatacaaaagataaggaggatgcaaggcatagatttctattgtcctgcctgggatagggtgtatgcaagcgacgaaatatctgctatcctggatagcgcatttcatataattgcagatatcgagaagtgttcggcagcagtattcttggaatatgcagatcggagcatggaggagaagatggggcagatatgcaaagaacttcggatggagcatctatccaggaatccactgttttataggagcgtactgggcagcctggagcatagatagagatatggggagcacgttcttcgtgctctcttttcaatttttggatagagaaatatatggatcaatagaatccttataatggatgaaaagaaaacccgtgaaacgggttaaccttcaagggcattatacaggatatcaaggaactcgctattagtcggtttttctttcaacggataccgggctatttttattaggtattcccggtttccattataccagcaataagctatggcggtgcgcatacaatgttcgacattatcttgagatgtctggtatttcctggcaacttccggatatatgtacttgcagatggactggatcttatctccgtcatcaaggcagaggcatagagcatgcttaatatagtggaagccctggtacgtagaacgtatgccaagagtgagcaaagtatctttaacacgtttatccataatttcccctcctttcgttattaataacacttaaagggcagaaaatacaaaggagtggagcgaattctatgaaaacatatagaattcgacaaagcggaaacagaagcctgtatgtctccggatctttatgggaataataggaagcagcagataatgatataagggaggcagattatgaacgaatttttgacaagttatctaggcggcatcataccggtagcattcaggattcaaagtggtgaggaaagcatgatcgtaggaagggaccggcctgagtttacggtcacgcttaacgaagatctggacaagaaagaattgctgaccagtacttctctggcgcttggggaggcttatatgaaggaagaactggaagtagacagagacttatatgaagtcttgaatctgtttcttggacagatgggaaagtttaagacggataaatctgctttgaaaaaattaatccttacatcaaaagcaaaaaagaaccaagaaaaagaggtaaggtctcactatgatatcggcaatgaattctaccgtctgtggctggatgaaacgatgagctattcctgtggatattttaaaaatgcagaggatacgctgtatgacgcgcaggttaataaggcggatcatattctggagaaactgcagcttcaggagggaatgaccttgctggatattggatgtggatggggattccttctaatgcgggccgcaaaaaaatatgggataaagggaaccggcattacgcttagcaaagagcagtaccagaagttttcagaggatatcgagagagaaggcttgaaggactgtctgcaagtcgagttgatggattacagggacttgaagcatagcggcgcccagtttgaccgcgtggtgagcgtagggatgctggaacatgtgggcagaggcaactatgaattattcatggagaatgcggaagcagtgctgaagccggaagggttattccttctgcattatatcagcgcacagaaggagcatgagggcgacccatggataaaaaaatatattttcccgggaggaacgatccccagcctgcgcgaaattattgatattcttccagaatacgaattccacgtgctggatattgaaagtctgcgccgtcattataatagaaccctgctttgctggcgggagaatttcctgaagcacagagcggagattgccagaatgcagggagaggaatttacccgcatgtgggaactttacctggcttcctgcgcagcgacatttaataatggaattattgatctgcaccagatcctggtctcaaaaggaatcaacaacagactgccgatgaccagggtggtataagcataaggggggataggccgcatgcgccgtctcccctaattgattattgattttctatggaatctgtgctaacgtatcctatattatctattctattttgccagtaagctggtgtcagcaactcttccgcggattctgcgggccaattcaatttgaatgatgatattttagaagggagcagtctatgggtaagaacgacatagcagtaaaacaatggctttctgcaaaagaccggtttgcagatttatttaacatgctgattttcggaggcagcacggtcgtgcatccgcaggatttggaagatatggagggagaggcagatatctttgttcctgacaaggcaggaggggagagtgggataaagcgttatcgagacattgtaaagcgatggggaaatacggcgacgtttgcggtgatggctgtggaaaaccaggacaagattcattatgctatgccagtaaggaatatgatatatgatggactggcatatacctcgcagatgaatcagatatgggagcagcgcagcgagaatagggaaaagatgtcggatgcagaattcttgtcccgctttcggaaaggagatcacctctatccagtgattaccgcggaaaggctggaacggacagaacttttttgcacggatttacaacagatttttggcatgttaaaatacaggggaaggaagcgggaattaattcgatacattaatcagcataaagcctattttagtaatctggatcaggaaacttatcgtgcagccagagtattccttaattctgaaaagcagctgaaggatatcgcaggtgatgaaaaggaggcgattgatatgtgcaaggcattagaggaactatatgaagaaggtatggaaaagggcatggaaaaaggcatggaaaaaggcgaggaacgattgaaccagttgataaaacggctgcttgcggattccagagaggaagagatatcgaaggtagtgggggatagggagtatcgccagcggctatatcacgattttcaattataagttgatacatagacaggaagcgaagcggatggagaatgtccgcttcgttttttatcggcgtactgtaattgataaaatagaaatcagcagtaaaattcattgacaggctagtaaacacttgctaaaatgaagaaaaggctagtacttactagcaataatcagaaagcaggtgcatcgaatgggagagtttaatctggagtcctatctgagcaacggagtagaaaatatcgtaaaaggcgttatgaaagcctcggccaagaatcctatggccagcgtctatatgatgcaggcagtaaaagaaaataagcgggcaaggcagatgagacagaaagccgagagcggggggaggcacattccgcccttcctgattgccagcattaccagtcagtgcaatcttcactgtaaaggatgctatgcccgggcaaatcacagttgctgcgatgaagaggatggcaaggaaaaacttctggatgccggacaatgggaagcaatattcgaacaggcggcagggctggggatcagttttatccttttagctggcggcgagccttttgtcaggaaggacgtactttatgcggcgggacggcagaagaagatattgttccctgtatttaccaacggaactttaatggacaatgattctctggaaatgctgtccaggaaccgtaatctgctgccagtgctgagcatagaagggaacgagagaacgacggatgcaaggcgcggggatggcgtattttgtacattaaagcagacgatggaagatctgaagtcaagagggatcttattcggggcatcggtaaccatacataaggaaaatgcgaaggaggtattgtcagaggaattcctggaggatctgaggatgtccggctgcaaagccgttatctatgtagagtatgtaccggttgaccatgcaagcatggaattggcatttgatgattctgacaggaaggccatgcaggagcggcttgcggtacttaaggaagaagatgagaagatgctgtacatagcgttcccaggagatgagaaaagttccggcggatgtctggcggccggaagggggtttttccatatcaatgccagcggcggcgcggagccgtgtcccttttctccatattccgatacctgccttacagaagcatctttggaagaggcgctggggtcccctctatttaaaaggcttaaggaagaaggagcgctgatgggtgagcacattggcgggtgcgtgctgtttgagcaagaggaaaaagtaaaagaactgctgggagggaatctttaatgacaacgagagaaagaatcgtggatgaggcgttgactctgttttcaataaagggctttaaaggaaccagcgtcaagaatatagcagatgcggtaggaattaaggatagttcgttgtataagcattttaagagtaaaagagaaatctttgatacgattgtcctaaagatgcgcaagaggatggagtgcatgacagagcaaatcggactgccggatgaagaaaaactggaagaggccgcgaagttctacggcaggatcacgcttgaagatttgcaggagttcagccgtaaggcatttctcttttatctgaaggatgaattcatctcccgattctggcgactggcaaatatggagcagtatcagaatccggagatatacgagatttacaggcaaatattcatggaagaaagcattgcgtaccagaagcagctcttcagtatgatgatacacaatggctcttttgcaaaaggggatccgcaaataatggcaatcagtttctacgcgcctatcttttttctgctgagcaaatataatggcagggaagagggcgtatcggaggcccttgacattctggacaggcagatacaggaattttaccaaatatacagccggaaaagccaagagaaagaatagccgagagccggcatgtctctggctctcagccttgccgtaagccagaaacgccaaagtatgtacaaggagtggaagcaggagcggattaagatgaagagaatcccaggatacaattagagccgattggaagcaaaggctatatagaactgatgacgattaaaagaataggatgcctgatggatgtccctgagcgggacgtccatttttgcaaaaatgttattaaaaatattttatctgtactatattttaatattgacaatggtgtgcgccacacagtataatgaaaacacaaggaggagccactatgggagaagaaaaagatttgatgcacaacctgatatcggaactgcgcagaggaaccttgatattaagcgtattaagccagctcagcgaggcgaagtacgggtatgcccttgtgcagagcctggaggaaaagggcgtggagatagatcccaataccttgtatccgctgcttcgcaggctggagaagcagggaatactaacgagccagtgggatgtgggcgagtcaaagccgagaaaatactacagcaggactcctatgggagacgacatattccggcgcttaaaagaacagtgggaacagctgtcagaaaacatggagcagatattgagggaggaagagatatgacagacagggagaaggaattagtcaaccgctatgtctatgaggtgacaaagaggatcccgaaagaacaaagaaacgagattgaaatggaacttcgggaactgatcgaagatatggcagaaggggcgccgcttgaggaagtgttcgtaaaacttggggatccggcagtatttgccaggaagtacagggaagataagaattatgtcatcagcccggaatacttcgataactatgtctgggtgatgaagatcgcgattgcatgcatatgggcagggctgcttatcgccacggcggtgaagtgctttattgactatcaggatatcatccggatagccggcgagtttatcagtgacgcagtcatggcatcgttagcaatcgttggaaccgttaccttgatctttgcatttctggagagacagaaaatcaaagtggatttgaagcaggaaaagccgtggtcgccggatatgctaagcccgattccaaataagaagtccaggatcagcagaggagactgtatcgcgtccctgatatttcttgcgctgtttagctgcctgcttatttttgcgccgcaattgatcggagcatattcggtaaacggaagggatgtctcatacgtgcctgtctttaacctgggacggtgggatgtgatattgccggtacttctttttgcgatggcggtgggattcttcaatgagatcatccgcctgatttacggatgctactgcaagatggttttgctaagcagtatcgtgaccaattgcataggtatcgttcttgcatttatcgtgctgaagctcctgccattctggaatgctaatttcgcgcaggaggttgcgacacagtttgatgatacatttaaattcaaagtattctggcagaataagatgattctggggtgggatggagacgtcctgtcgaatgtcctgctggcaatcattgtgatcgcctctgtaggcgagatcatcacgactgcgtataagacggccagatatggaacagacagatagaaaagaagacacgcctccaggatgcgattcgcttcctagggacgtgtcttttgttttagaatgctttcaaggaattactgtgcctttgcagctttttcctttttcacgatgcggcttaagataaaggtaatgatagcacagagtactgcggcaaccattgcataagcccatgtcatattgtagccggtcctgccgtaattatccatccagctgccgactaaggtatacataaagatgtcaggcgtgtagcctaagcaggatgcaataccagatacacggccactcatgttgagcgggatgcctgcatcgtcatgcactgcgaagtactggcttcttacggcgtagataaagaacaggccgacgaagaagtttgctactaccatgacgcagaggctggcttttgatggtacgacgataaagaggccgaaagataaagccagaccgatacatccgccgatgataactttaaagcgggatttcaacttatctgccaggaaaccgccgacaataccgccagcaccctggatgaggtaacggataccgccgagcgtagcagctgatgcagcggataatccatagaatttctgtgcaaatgtggttgcatatgcaatcagtccgtatacgctgtaagcagtgaagacgattgctacaagcagccatactctcgggatcaggagagccttgaacataccctttgtaacttctataaaggattcggaattctcttccttctttgtatcttcgataaagataaagttaaggataccaatgataataactacgatagagcatactttgattgctgcggatgctccggcaacttcatctgcaaagtgagtaaatgcagccgtcataccgaatacaagcagagcgttcataatacctctgagtccttcctgaagtccgaacagacgtccctgctcttcctcagtaccgagcatacgcgttgccttgatgcatgcggaccagtaggtgataatagtagagatacccataagtacgaagataacacggcttatggtatagccagggaatgtggagaaccaaagtcccagggcacccgttgcgataaaggagaaagtaagcagctttctcgctgaaaacttatcggctataataccgcctataaaataagagaaaagtgacattgtcgcataaccggatgataacagtcccatctgcgcgttagacaggttcattgcattctgaatcggtacatagaaggtttctcttatgtacggcaactgaaagatgattccggcaccagttgctagaagaagcagagtgccatacttcttaataaaagctttgttcatgatttcgcctccagattaactataataatttagtggtgatatggcgctgcagtcgccctatctgttatgaatgtaacaaaaaaagagaaaagtaatgccttgacagcgttacttctctcctcactctttgtaactaacacgaatcataaaatatttgtgaaaaaaagtcaatcaaaaaactagtaaaaattgaaatataatcattctgcacaaaaactatgatccaataatatgaaaaataaccaattgacattttgcgcaaaatggttttatactatatgcagttaccgaaagagattttcagagaaaagtaaccagcgtggcaggagttccctgctcgtgttgtgttacttttctttttttattcccatttatctcccacggtgaagaagcaaagaaaaatgcgttataatgaaaggagcccagagtcatggcaattatttcaagagaacaaatcgtagaaggattagttgatatccttggaaaagatcaggtcgtaacagacgagcaggtattaaaagaaagcagtatcgacagatacagaaaatatgagcaggtatgcgaagtatatacgcagcctatcccggcagcagtcgtatatgttaagagcgccgaggaagtatcagaagtgctgaaattcgctaatgataatgaaattaacgtagtgccaaggacaggacactccgcgatcgagggcggacttgagacagcccttaaggattctgtcgtaatcgacggctctactatgaataaagtaatcaaggtagatgagtacaacatgcaggttacctgccagtgcggcgtaccgcttcaggaactggatgacatgctcagagaaagaggacttacgacaggacattccccacagtccaagccgcttgcgcagatgggcggactggttgctacaagaagtatcggacagttctctaccctgtatggcggaattgaagatatgatcgttggaatggaagcagtattcccgaacggcaagatctgcagaatcaagaatgtaccaagacgtgcggcaggaccggacatcagacacatcatctgcggcaacgagggggcgctctgctttattacggaagttacattaaaactcttcaaatggcagccggagaacaaccgctatatcggatacaagctggatgacgagcacatgaaacttggatttgactgcctgcgcgaggttatggtagcaggatataagccatctttcgcaagactttatgatgcggcagatgcgcagcagcacttcagctcctggctggaagaaggcaaggcaatcctgatctggatggcagaaggcccggcaaatatcacgcctgcgatcgaagaaggcatcaaggatttgatgtccaagcatccagaactggaagaagtagatccgaagctgatcgagaaatggtatggcggactgaactggggaccagagcagatcgcggaagagaaggaagaaatcaaggctacccagaacatcggcattacgacagaggtatccggaagctgggataatatttatgaaatctacaagactgcatgtgacagaatcatggaagaagtaccggatatgactttgatgggaggacactcttctcacagctatatcaatggaacgaacatgtatttcgtatactattacaatattgtagactgcgctccggaagaagagatcaacaaatatcatgacagaatcaaccagattatctgcgagcaggttatcaaatacggcggatccatcgttcatcatcatggacttggaaaggcaagagcaaaatatgtaacagaggagtatggatcttcctactatatgctgaagactctgaagcaggcattcgatccaaacggcgttatgaacatgggaacattgattccgctgcggaaataatccatgaagatcttagggtgtttcaaaatagttccggatctggatttcattgcacaagaagactggatggcagatggacagcttcaggtagacactagttacgcaaaactgctgtggaactgttttgatgaaggagcactggaaatgatgttaaagctttctgatttatcagaaggctttgatgtcgtatatgaactgaatgcgctgacggtcggcaggctccgtcatgaaacctttttaaagaccttgtatgcgcttggatttagccatgctgtcagggtagaggcagaagaggatatggacttaagattctgcccgggcctgattgcagatgtaacagcaaagtacgtaaaagagactgcttctcaggatgtgatcattatggggacgcagagttcggatggcagcaacatgaagacgccgctgcttcttgcagagaggcttgggtggccgtgcatcacgcaggtgacggcgttggaacccgtagatgagaagcatctgagggtaaccagccaggaagatggaagaacggcggtacagattgtaacggttcccgtcgtgctggcggtaggaaatgcgccttgtgcctacttaagggtacctacgctgaaagacaagatgaagtttgggaaaaggccgatcgagcatatcagcctggacaggaaactggcggaaagccagagccggaatgtagagcttatggaactggcgccgatagatgacagcagggataccatacggatagaaggagagacgccgcaggagaaggcagagaaactatatgagacgtatctgaaaggaaggcttgaaaaactatgagatatcattgtattataaatgcatattctgatgatgccatccgccagatggaggaattccatgcgttccaggatgccttcctgaaggatgccgagcagggcgaggcctatattctttgccgcggcaatgaagatatagaactgcttgcaaggcgcatcgctgaaaatgcggttacggtgactgggccggactactctccggaggcagttctggaggttcttgaacaagaggcagattccgaagacctttatattttcgggagcggctacagcggcatcgaactttctgtaagactctccgaaagacttgggggaagttccgtaacgtccgtccatgccttggaattaaagggatctgtgacggcaaggaagatggtctatgcaaaccatatggaaggcgcgtttgcgatgaagaaagggccttactgtatctcgcttgcgaaaggaatggagcgcaaggaggcacaggaaggcatgttccatattgagagggaacttcgctgcagaaagggaaacgattttgtggtttccagggagaccatgaaagaagagacagccggaggcctaagcgatgcaaagatcgtggttgcggctggaagaggaattcggaataaagaaaatgcaagtttccttgaggaaacggcaaaagccttgggcggagaacttggggcaagccgtccggtggcgatgaatgcctggacgcctatgagcaggctgattggcgtgtccggggaaatgatcgcgccggaggtctgcattacagcgggcgtatccggagccgcggcgttttatgcaggaattgaaaagagcaagtttatcgtagcaattaatacggacgagcaggcgccgatcatgaagaaggccgatgtggcgatcgtggacgatttcatgccagtgatccaatccttgcgcgagatagtaaaagagcagaaggatacgctggagtaagaataaatgacaggggatgggcatatgagacaattgatttatccgatgaaagaacaatatgaagagtttttaatagacgagtcaaaattttccggatatgcggacagcatttctttcccggagagcgaagaagagatgcaggaagtgctgcaggaactgaaaaaggaacgggtacccgtgaccattcagggaggaaagactggaattaccggagcaggcattccaagaggcggacatgtcatgaacctgtctcatatgaataaagtgaaagacagtgtcctgctggaggacgggaccgggctgatcaccgtggagcccggtattaacctgatcgatcttgggaaagagattgccgcgcggttcaggaagacccccttattctggcctccggatcctaccgagagttctgccacggcaggcggcattgcggcgacgaatgcccaaggcatctgtcggcttttatatggaccaagcagggattacatcgcgtctttaaaacttatgaatagcgatggagagatgatgtcgatagaaaaagggcagaaactgacccttgcgtcaggcagggaaatcgaccggatggatgcggtgctgggaaaggaaggaatcaccggggcaatctgcgaactgacgctgaaactgatcccgaagccgcagagccagtgggggattgcgtttttctttggcagcagcgaggatgcaggaaggtttgtcgacattcttaggctcgacatgccgcaatgcgagcatgcgaaggtagctgcggtagaatacattgaccggatggcgatgaacctgatcgaggagcataaggctacaatgacgaagatcaaggaactgccggatatcggggaagagacacagagcatggtctatatagaactgcacggagacgaagaggaaatagagatccttgccgagtccttgatggaatcggcgatggtatgcaatagcgacccggaagaagcttgggccgtatccggcgagacggatgtggaaaaaatgcatgcgttccgccatggagccgcagagacatccaatttgtatatcgagaaagcgcggcagatggatgcgcggatcaccaagctgggaacagacatgacgatatccggaacgccattttcagatatcctttcttatgtagaaaaggaacttcacgatgctggattaaagggcagcgtatttggtcatgcgatggaaaaccatctgcatgtaaatatacttcctgagaattacgaggaatacgaggcaggtatccagttgatacgcagatgggcatcgcaagtgagcgaacatcagggaaaagtggtcggcgaacacggaatcggcaagctgaagctggaaatactggacggattcgtgccggagcgctatacagagctttgtaaagaattaaaaaggcagctggataaagacagcctttggaacaatggaaatatatttaaagaagaggaggctgccatatgaagatcgcagtatgcatgaagcaggtgccagcggcctccgaagggaatatggatcctgagacaggcgtgctcatccgggcagggcttcaggcaattgtaaatgtatatgatctggcggccttggaggccgcccttaaaataaaggaaacatacggtgcagaaatccatgtattcacgatgggaccacagaaggcagaaagcgtgcttcgggaagcatttgccatgggggcggatgaagggttcctgatctgtgataaggcctttgcaggcgccgacgtgcttgccacatcctatacactgatgcaggccataaagtcagcgggagattatgatctgatcctgtgcggcaagcagacgaccgacggcgataccgcccaggtaagcggcgcgctggcaaggtggatggacatgccgcatgcaagctgggtggtcgaaattgtaaaagttcttcaaaatgcagtcgaagtgagatataatatggatagccggacgctatcggcacgggttgcattgccctgcctgctgtctgtagagaaggattccttcgtgccaaggatgccatcgcttaaactcaaaatcagtggaaaaaagaaagagatccatctgctggggattcatgattttatagatcaggaagaagagcattatggcctaaaaggctcagccacaagagtgaagaagatatttccgcctgagcgtacgaagcgtcaggacgtagcagcattggaaaaaatagaggcggcggaatatattctgaatatcttagctgtggacaggcaggaggaacagagatgagacaggcaaatatagaggaatggtctaagatcctggtatatatcgagtgcaggaaagggaagatacacccggtaggacgcgagttgatcgcagaggcgtcaaggcttgcaaaaaggcttggtatgccggtctatgcggcagcgataggcagcgatctggaggagatagaggggcagttaagcggctgtccgcttgagaggctctatctatacgaagcggcggatgagtatactccgcttgcatatgagaagatcctggcggattgtattaaggagattaagccttccatcgtcctgatcggtggaacctctgaaggaagggcgctggcgcccaggcttgcggttgcttttgagactggcttgacagcggactgtacttcccttgagattgatgaggagggcaatctggtgcagatcaggcctgcgtttggcggaaatgtgatggccagcattgtgacgcgctttacaaggcctcagtttgccacagtaaggcctggggtgatggagccagcgtgtatagaaggacagccggctccgaagatcattagaagaacggtgcatgctgatgaagatgcatttcagattctggaagtaaaagaggcgaaggctacagagagcattgcggacgcgcgtattcttgtcgtggcaggaagaggcgtcaggaagaaagaggacctgtcaatgcttgaagaactggcagtccttcttggaggaagacttgcctcaagcagggccctggtggagaagggatggatgcctgccaagtgccagatcggcctgtcaggcaatacggtgagcccgcaatacatcattacctgcggggtatcgggaaccgttcagtttatggctggcatgaagcatgccaagaatatcatcgcgatcaatacggatccggatgcgcgaatattcgagattgcccactatcctgtacttggcgatctgtatgagatcgtgccggagatgatcgggcggttaaaggcaaagaaaggcgatgatgttgctgaaacttagatatcaattaacaaaagatgagatagaggaagccttgctggatctgaactggagaaaggaaggcgttttccgcagtataaatctatgggctatgagtctgattggcgtccttttgctgatcggatatatgaggaatcccgggcagttctttctgttcctgcttttgctgcttgacatacttctgctcctatatatggcatatgggactgcgttcctaagaaaaagaagggctgggaagatcgcggccaaggagggggaataccggattgagatcacggagtcatatgtcgtggtaggagatgcgtctaaaaagacagagttatccggcagaaaacttcagtttctttgttccgagcatgtattggtcattcggctggacagagaagttgttacgattccccggcggatattgacggaagacgagtatgaggcgataaaaagaatcgctggacgatacaaaagtaaatttataaatataatgacgggaaaggagtaacaagatggaaacagaagtacaagagaagaccgtgaaactatcgttgaggaagggagtattctttccgccctggctattactggtggcaatggtcgtagtgagccttacgaacggcgaagcctttatggcaggacttaatacggtgacaaattggatactgggcaactttgcgtgggcattcaacctgacgacgctggcctgcgtgatcaccgttatcatggtatacttttccccgcttggaaaggtgcgtatcgggggaagcaaggcaaagcctatgatgcggttcatcgatctggtgtggatcacgctatgcacgacggttgcggcaggcatactgttctgggcatgtgcagagccgctgtatcatatgtacgcgcctgcggcagtagaaggagtggaagcaggaacagccagttccgccctgtttgctatgaagacgatgttcctggaatggacctggtctccatatgcgatctataccgtagcaaccctgatcttcgcgttcgtattctacaatatgaaccagtcctattccatgggatctgcgctggtgccggtctttggagaaaagataaagaaatacaacggagtcgtggatgtcatctgcctgtttgcccttgtagccggaatggccgcatcgcttggaaccggcacgatgacgattgggggcggcatcgagaaggtgtttggcatcaagagcggccctgcggcgtggggcgtgattatcgccataatcgtgaccacgttcatcatatcaagcatctcagggatcatgaaaggcattcggcttttgtcgtctatcaatgccaaggtatatatggttcttctgctgttcctgttcgtattcgggcctacggcattcatgctgaacttttccgtggaatcatggggcgcttatatccaggactttttcaaactgagcctgatgacaggagatgtattccaggatagctgggcaaagagctggccaatcttctattggtgcaactggctggcctggacgccgataaccgcggtattcctgggaaagatcctgaggggctatacgatcaaggacgcgattaagtgtaactttgtcattcctgcaattttcagtactatctggatgggactttttgcgacggcttccatttattatgaattgaatggcgcaggaatgtatgatatattgacgagtaaaggggcagagtctgtggtatatgccgtatttgaccagctgccgctttccatgatcgtgatcccgttctatctgttcatcgtatttatatcatttgtcacagcatccgactctaatacgaatgccatggcaggattgtgcatgagcggcattacgcaggatgagcaggagtccccggcatggcttaagatcgtgtggggcatctctatcgcgcttatgacgtggctgctgatcagtttcgcgggaatcgacggaatcaaggcagcatcgaaccttggcggcttcccgaatatgttcctgatcatcattatgatcattggattatggaaattaagccacaatccgaagaagtatgatgtacacaaagaagattatgacagcagcgggcggccgattgaatcgccacggctgccagttgaaaaggagtaagacgatatgtctttgacaaaagaatactttatggaagcaacagaagcctgcccggttattccggccatcaagaatgacgaatggctggaaggctgcaaggagtcggaatgcgggattgtctatatcatttacggagatatctgcacgattgcagatatcgtggataaagtaaaagaaatgggcaagaaggcaatcgtacatgtggatctgattttaggcttgtcatctaaagagatcagtgtggactttattaagaagtatacgaaggcggacggcatcataagcatgaagccgacgctgatcaagcgcgccaacgaactgggcatgttcacgatacagcggttctatatgatggacgcgcttacctatgcgaacatcgtcaagcatgtcaaaaactgtaacccggatgtggtcgagttcctgccggcgggattgcccaaagtcatacaatatctactggaagagattgacaagccggtggtagcaagcgggctgatcctggacaaggatgatgtcatgggggccctaaaggccggcgcatttgcggtatcgaccaccaaccgggaaatgtgggactgttaggaagaaggagaatgaaatgaaagcagacattgaatgtcatggatgctgcgtccagaaggcagaagggcttctggaacaataccaggtgccggatgagaagaaggcacaggtcatggaggcggttttagagacggtgaaaggggctggggcagaagaatccgccccggtgatgatggctcgcgttatgaggatattggagtcagaagtgggtattacggatgcctatgatatcccgaagcaaagatacaatgaacttcttttaagcaaggaagatggaatatgccaggagatacgacaggagaaggatccattctttgcggccctgcagtatgccattacagggaattatattgactttggagcaatgtcggatgtcaatgaggagaaattaaacgaactgctggcagatcgccacagcgttacccttgatgccggggagactgccttgcttagaaaggaattggcctgcgcgaagaaactggtgtatattacagacaatgcgggggagatcgtgctggataaggtctttatccgcgtgattgaggaaatatttccggaactggacattacggtgctggtacgcggcgtaccgactctgaatgatgcgacggtggaggatgccgaatttgccggggtggatcagctggcccgcatactgccaaatggtacggatatcccgggaacgcctcttgaggagatcagccaggaggccttaaaagcaatcgatgaggcagatctttgcattgccaaaggacaggggaattttgaaactttgcggggatgcggcaggaacatatattatctgttcctgtgcaagtgccagcttttcgtgaagaagttccaggttgagcgcttcaccccggtacttagtaatgaaacaagaattgtgcaatatgcataaaagccacccctcgcttttaacaacaatcacgatattgacaaatgaattaactagacttaaaatagacgtagttactaaaagagcggaagagagagtaacttttacccacggcaagtgggtggaagttgctctctttttgttcggggcttctattgtgcgcaggtagaatccggaaggctctttttaataaaaataatgtcaagagtatatggaggtacaaaatgagtttgaatattaatgatttttctatggatttcttttcactgaagggtaagaatgcaatcgtaacaggcggaaacagcggactgggacaggcattcgcactggcgcttgcaaaagcaggagcaaacatcttcgcatttgcatttgtagatgatgacggaacaaccaagaaactgatcgaagactgcggcgtaaaatacacatttatgcagggagacctgacagaagacggaatgtgcgacaaagtagcagagaagtgcgtagagacctacggaagcatcgacatcttagtaaactgcgcaggcatctgcaagatcgcagacgtacttgactttggcagggcagagtgggatccgatgatcgccatcaacctgacaggcgcattcgacttaagccacgcggttgcgaaatacatgatccctcagaagagcggaaagatcatcaacatctgctccctgttctccttccttggcggacttggatcaccggcatacgccgctatgaaggcaggacttatgggtcttaccaaggcttatgctgacgaacttggaaaatatggcatctctgtaaatggaatcgctcctggatatttccagacagcaatgacatctggtacaggaagcgccaacgatgagaaatataacaagatcaaagatcatattccggctgaccgctggggcgagagacaggatcttatgggcgcgaccgtattccttgcaagccatgcttccgactatgtaaacggaaccgtgctggtagttgacggcggataccttgtaagataattatttgaatcaaataacacgaagaaagaggtttggatcatgagtgagaaatatattatcggaatcgatgaaggatcccagagtgcaaaaattcttatatttgacactaagggaaatattgtatgcgaggcaaagcacgcattaaagccatataaccttccgaggccgggcatcgtagagcatccggatgacgactggtgggatgcaatctgcgaggcaggaaagaaatgtatggcgaagttcgaagggaataaagaagacatcgtaggaatcggactatgcacgatccgttactgccgtgcttatctgaaggccgatggcacgctggcccagccagcgctcagttggatggatatccgcgtggcgcacccttacgagcataccaacccagatgtaaaatacatcgtggcatcctccggctatattactcatcgcctgaccggagagaagaaggacacggttgcgaactatgaaggcgtatggccaatcgacgtggacaactggggctggtcagaagatccggccgcatatgaggcaaccggcatgccaagagagatgctctttgacctggtaatgccgggagatatcctgggatatgttacgaaggaagcggcagaagccacaggcttcccacagggacttccggttgtggcaacatcaaatgacaaggcggtagaaggactgggaaccggatgcatgggcgatacgacggcgtgtatctctcttggtacctatacggcagccatgatggagggaaaagagaacttaaaggatacaaaatgcgtatggccgaagttctcctgcgttccgaacaaatacctctatgacagcaacggaatccgccgtggaatgtggaccatcagctggttcagggatatccttggggacagttacatcaaggcggccaaggagaaaggcttatctgcggaagaactgctaagcgaagaagcagagcaagtaccagcaggttctgacggcctgatgacggtgcttgactggctggcaccagtggacgccttatataagaagggcgtaatgatcggctttgacggaagacatacaagaggccatatctaccgctctattctggaagcagttgcactgacgatgaagaagcatgtagatgatatgtgcgatgagctgggcgtcagtctcgacaagatcatcattaccggaggcggttccaatagcgacttgttcatgcagatattcgcggatgtattcaatatcccatctgtgcgtaacgaagtaaacggagcagcagggcttggctctgcgatctgcgtagctgttgcggcaggcgtatatggcagttttgacgaagcggttgccaatatggtaaggattaaggacgcattccagccagatccggagaaggtggcattttatgagaaaatgttcccaatctacacggatataacgaagcatacggacgaagtactgaagaagtcttacgaactcttccaataattttatatgaagccacttatcttgatcacgaatgacgatggcatccattcgccgggccttgcagctgcggcatgtgcggcggcagatcttgcggatatcttgattgtcgccccgcacacccagcagacaggtatggcaagagcatttccaagaaccgaggatgccgggataatagaagaagaatggatacagattaatgggcagaaagtgaggggctatggggttcatggctccccggctcttgccgttgcgcatggcgtgctggaactggcagagcgaaagcccgacctgtgtatcagcggcgtcaattatggcgagaatatgggagccgtgcttacatgcagcggcacgctgggagcggcatttgaagccataagccatggcattcccgccatcgccatatccctggaggcagaacttgccatccagcgatccaatgatttcaggcagacagactgggatgcggctaagaggatgcttcattcatggataagccgggtgttggatagagggatgccggagtatgtagatctgatcaatatcaatatgccggcgggcagcggacatcctgacgaatttaggatcacatccttaagcaggcagaattatttcgaattcattcggccaaaggccaggaatttaaaggagccctttgcgcttaagtccaggctgtctgtagatatggatacgctggaaagagatagtgatatctatgcggtgtatgtggatcggattacctctgtcacgccgatcaatatgaatatgtccataggtttaaaagaaacgatggtggagaaatatatgtaaagaaacaggccttttttagaggcctgtttttactgttatttcgattgactttaaagggcaatttgatatgatggagttaacaatagattttgttaatacaatttattccggaggcgtacatgcaaaagagaatctttcctgtcttattaacggtggcactggtattttccagcattttctcccttttttccttacataatcttcagggcaatgcaaaggtgattaactatgcgggagtcgtgcgaggggcaacccaacggcttattaagcaggaattaaacaatttccccaatgatgcgctgattgagaaactggacggtatcattgatgaacttcagaccggaagaggagagcatggcctgatccgactaaatagcagccgattccaggatcttatagcaaagatggaagcggactgggagcagttaaaagaagagatctatgcggtacgttcagggggagacagcgaaaaactttttaaggacagcgaggcgtactttgaattggcggatgatgccgtctttgcggcagagcagtattccgaaaaaagcgagtttatcgcagagaaaggcctgcttattctaaactgcgcgtttgtcctgatgatcatctttctgtacatttataatagcaagcagttaaaaaggcagactgcccttcgggaagcagaggaggaaaaccagagaaaacaggaaaaactgtcccggatgcaggaagcacttcgttaccctctcaatgaaatctcggaacttttatacatttctgatccaaacacctatgaacttctgtttctgaatactgcaggcatggaaaccttccatgtggattctttggaaggcaggaaatgctatgaggtcctgcagggaaaagaagcaccctgcgagttctgcaccacgcatctccttagagaaggggaaaactatacgtgggaattcaccaatccgctgacgaaccggcactaccttctgaaggaccgcctgattgaatgggagggacgcaatgccagaatggagatagcctttgacaccacggagtcggaaaaggagaagatgcagttaaagtatacgatggaagcggatcagatggtaacagactgcgtacgtaccctgtatcagaggagcgacatccgtatagcgatcccccaggtcctggaaaaactagtaagcttcttatccgcggaccgggcttatatcatccatatcagggaagggctgatgtacaatgactacgagtggtgtgccaagggaattgctccccaaaagcaggctttgcaggcaatgcccgtaggattgatagaccggtggattcctttctttgagaaaaaggagtgcgtagtcatcgaggacctggagaaacttaaggattccgcgcctgaagagtaccgtatccttaacggacagaagattaagagcattgtggtggcgccattagagcaggatagggaattgattggctatctgggagtggataacccgcccccggaaagaattacaaatatcggtcctctgcttcagacgctaagttatttcctgatgctggccaggcagcattcagagagccagcagcaactgactcatctcagttactttgatgttttgaccgggttctataatagaaaccggtatatagaggatacgcaggaactgaatcatatggaggcctcattgggaatcgtatatctggatgtaaacggactcaaggatattaacgacaagtatggccatgaattcggagacaaggttttaatcgagtgtgccagacgaatgaaggtggtatttaaggatgctaacttctatcggattggaggagatgagtttgtcattatctgtccgggaatagaccaagaggcctttcaggcgcttctgcgggaattgaaggcccaatttcgcaaggatacgaattatcaggctgcgatcggcgcgcaatggatggaatccatcgataatataggccatattattgcggctgcggatgcccatatgtatgaagataagagggccttttaccacaggcatccggaatcaaaccgatatagacattacaatgatcagattctccggctggcggacgagcaggcgctgaaagaagagttagaaaagggccgtttcgccgtttatctgcagccgaagatatcgtctgcaaattgtagggccgagggggcagaagcccttattagatattgcccggataaagatacccgggtgatgccggataagtttctgccgcttttggaggaattcgagataatcagcctgatcgacttcttcgtattccggtctgtctgcggaaggctaaaggaatggatggaacaaggaaaagaaatatttccggtatccgttaatttttccggcgcatcactgcgggaaccgtcttttgtagagcagcttacagaaatctgccgcagcaatggagttttggaaaagtatatggagatagaagtcacagaaagagtacatgatgtggatggtctggatatgaaagcggtgataaaggaactgcgaagcgcgggatttacggtcgcaattgatgattttgggacagaatacgccaacctctcgcttctgtcggaagtagacttcgatatactgaagcttgataagagcatgattgaccatatagctacgaaccccaagtccagagcggttgtggagaccgtctccaaagtctgccataaactggggatctgcatggtggctgaggggatcgaggaggaggatcagtttgagattctgcgcgacttcggcgtggaattaatacaaggatatctttttggaaagccggtatcaattgaagaattcgagcgacgttacatcggctgacagaaatggaaaataagaaaatgacagattgtaagaagtttgtaagaactccttgttttaatggatatagataaaacaagacaaggagagagaaaacatgaagatattagaggcgaagggacttgtaaaatattatgggaagggcgaaagtctcgtaaaggcagtggatcacagcagtttttccgtggacaaaggcgaattcgtagcagtggtaggtaccagtggctcgggaaagactacgcttcttaatcttataggcgggctggattacgctgatgaagggcagatcatcatagaaggacaggatatttccaagatgaaggccgatgaattgacgattttcagaagacgaaagattggattcatctttcagaattataatcttgtaacggtactcaatgcttataagaatatcgtgatgccggtaaaactggatggcaataaggtagatgaagcctatatacaaaggatttctacgatgctgggcatcaagaacaagatgaaatcgtaccccagccagctctccggcggacagcagcaaagggtggccatagcacgggcgctgtcggctaagccggcgatcatattggcagatgagcctaccgggaatctggacagcaagaccagccaggaagtcatggggcttctcaagatgaccagcagggaattcgatcagacggtgatcatgattacccacaacgaagagattgcccaactctcagaccggacgatccatattgaagatggcaggattgttggaggtgaggcataatgttcgagaactccaacaaaggaattgtaagagagattgctgatgaaactatgaaagtgcatcgtctgcgcaatattatggcatgctttgccattgcgcttacggcagtgctgatcacgatcgtctgcggggcgggcattaccatatccaaggccattatgacagaacagcagatgaatcctgggccgggatcatacggagccggaattacaggcgggcctgacgtgttaaagaaggtcaggcaggctgaggatgtagaatgggcagatattgccaggccatgtatggaaggaactcctcacaataaagagtttgccggaaatgaagtaaagtttctgggggtcagcgatacttattatgaacataactatatagaactattgagtggagcgtatccgaagaacgcacaggaagtcctgatgtcagatacgctggcagagaagacgggacgaaaactgacgccagggcagaaactgacgctaaacctggcagtaatagaaaatggagtccgcatggaaaagccgatggaagtcacgatctcaggattctacgataatccgcttcgcgcgatccagggatatgaggaactatataccaccgaagattttccagacatttataacccggaactaaatgacaggaatacaaagatatttaccaagatagacggaattacggcatccacttccagcagcataaagcaggaaaaactggatgaggtcaaggaggaggcaggaggagaaggtactttctacatttatcccctggattatacggcaacctatgtcggagtggcagcagtcctgctcctgattattgcctgcgggtattttctgatctataatatcttctatatatccgttgtgaatgatatccgatttatgggagagatgaaaaccataggaatgaccggccggcagatacgtaccatgctgcgctatcaggtcaggcgtctgggagtcgtcggaattgccataggaatcctggcaggcacgttgatgaacctgatgacggtaagaattctcaaaagtctggactttacctttgccaggtattgcaagacaatgccgggaattcttctggccgtgcctgccgctattatcttttcgacggttaccgtgtggatcagcagcagaaaagcgctgacattggccgggaaggtatcccctgtggaggcatcccgctttcggacgtccggaaaaaggaaagcggtatttgcggtagtatccttcagtttaagcggagtgctgttctgcagcctctataccgcgctgatgggatacgatgtggagtatatggtaaggcgtcagaatgaggcggacttccgggtgtttcagtatcatgcggaacagtctatggattccccgtatgagccgatggactatgaattcgcgaaagaagtggcgtctctgccgtttgcagaagaaagttttatctattatggagcccgggatctaaaggaagagacagatataggattttatggcgaatccgcgggagaggtcaagtacgaaggggatatccgcgagttggtggatagagagtttgaagagtccggaggcgagccgtgggcaatacttccaaatgggaattacgagaccagggttactggcataccggcaggcgcccttaatatggaagaggagaacatggttatatacagcggcagtatagataaggagaagtttgccaccggagattatctgatctatcagcctaatgatggctggggcaaggggaaggattatgagtatcatgcgctaaaggcaggggacacccttacggtatccttctatgattatgaagccgaagattatgtggataagacttttacagtcatggcagtggtaggaggaaagccggataattacgctacaggattaaatacaggcatgaatctggcaattccggatcagacattcagggaaatatatggaagccaggcagaacagatggtttccggcgtctatcttaatacggatggcaaagacgcgaaagaccagcaggaaacgctggagaagatggttgcggagaactttaatccacaggtacatctaaggtccaagtatatggatcgcttaagcgagcagacgcagaaggaccagaagactatgatgggattatttgtgggactggtattcggattcataggaatagctaatattgtaaatacgctggtcacgaatgttctgtcacgtaagattgaatttgctgccatgcagtctatcggaatgacgaaacggcagctggcatttacgctatttaaagatggaatgaagctgaccggcatcagcttcctgattattgccgcagcaggggttccgatagccaaggctgtcagcgtgtacccgctgtccacaggattcgtgcctgcgatctatgtgacttcattgtgcttcgtgctatcagcaggccttttgctaatcgtgctgctggcaatatcccttacaggagtcttaaataagaagaccgtggtggagaggcttcgggaagcagagtagaaacgcaggcggcatggaggaaaaatggcatgtatcagatactggtagtagaagatgacgaagttctaaggaatggcatcgtgtatgcattaaagaaagagggttttcagccattgccggcaggttctttaaaagaattgaaggaagaactggccaaagaggcagatcttatccttctggatgtgtccctgccggatggagacagcagggattacctgaaaaggctcaggcagaccagcaggattcccgtgatcttcctgacagccaggaatatggagcgtgatatgatcgaaggattcaatgccggcgcggatgattatatcaccaagccattttccattcctctcctgatgtgcaggctaagggcgctgcttcgaagaagcggcaaagagtccggttccagatatcacgcaggagaactctcctatgattttgagacaaagacgcttaagaaatccggccaggagattgtgctaagcaagacggaacttaagattctggaagcattgattcaaaatagaaaccaggtgcttacttgggaggtactgctggagcgaatctgggatgtcgatggaaattttgtggataagaataccctgagcgtgaatattgcaagactcagggaaaagatagaaaatgaccgaaagaatccaaaatggatcgtgaacgtatttggaatcggatataaatggagtgatagagatgcccgatagcagcagaatgattagaagaattgtaggcagtacagcaggtatatggctcatatccctgcttgcgttctgcagttactgtcagaagaaggactgcgtatccgcctgggaggcgggtgcctttggaatatggatgatagcagtatttgcgatctcttatgtattgatcagccggatagtaaataagaccatggaaagggtagatgactgcatacaaagcctgatagacgggcagccggaccagcagtttagcacagaagaggaatcgcttttgggaaagttccagatgcagatcctgaaactgtaccgtatcatggaccgctcaagggaaatgcaggagcaaaaaaggggagaacttgcggagatggtggcggatctggtgcatcaggtcaatacgccgcttaccaatatccagttgtactgcagttttcttacgcaggatgatttgacagaaactgacagaagccagatatgtcaggtcattgattcccaggtagaaaagttaggatggtttgctgacggatttggaaaggcggccaggctggaaggggatgtgatgaagatccggccggaaacacagccagtccttgatacagttcttcaggccatagaccaggtcgcgcccaaggcgcagaagaatggcaatgaggtggatctgcttggagacaagaagatgaatgcctgctatgacaggaggtggacggaagaagcgctgtttaatcttctggataacgcggtcaaatatggaaggaaagagtccgcgatcgtggtggagctaaccgcttatagcatgtttgtaagaattgatataaaaaatgaaggggacgtaatcccaaggaaggattataataagttattctcacgcttttaccggggggacaatgcagcgcttgtctatgaaggcgtaggcttggggctttatcttgccaggaagatcataatggagcaaggaggctacataaaagtaagcccatgggaaaagaaaggaaacatattcagcatatttctcaggaagagataggaacgaatcgtttaattcgtgtcaatttgagacggttgaacgctttcgttccttttttgtgcaattattccgtgatagcatgaaaatagaagataaattcagtgaatatgcttaaaacaaagacaaagggggatggaatggaactatatgacgcaatcattcgaaggaccagagagtacttgtctgcatacagcccacggcgatacccatatgacgcaaagaagtgctggaaggagacggcatccggagaaatgatcctgcttcgggacgctgcttacgaacttggcggaggaaactgcgaatcggtcaactatacctgcgcgacttcagaccaggaattacttatggagaatgagatcttgctgtatggagaggaccttccggagttaaagcaggacacttcctttgcgaggatcgtattcttaaggacggacgccgcggataactttgagggagaggaggagctttatcgctttgtaagggaactggaatatgtacgctatcatattttccccaaggggtatatggtgcggacatcagccaagagcagccaggagcaggcaagggtcagcaaggatgccatagggtcaggaatcaattttgagaggcttggaagcacttatatcagaaaatatttaaagaaccccagggtaaggaatgtgcaggttcttttcctgacggggatgaaggaactagagccctttctaaaagaggcgcagcagacggatgcggtcacgggggcgctgaaccatattttgcagggaatgccgatgaattgcaagacctgcgatctgaagacaatctgcgatgaagtggatgggatgcgctcgctgcaccagaagaacaggtaacagaatgccaagaaaagaaaaaggagagagcaatggaaggaaatgcaaaggtaattgccgtaacaggaaaaggaggcgtagggaagacctctcttgcggcggggatggtacgcaggcttacgcagagatatccagacgcaaagatcctggcgattgacgcagaccccgctgtagggctcgcgactgcgctggatgccaaggttaaggagacgctggatgatatccggctggagattacgcaaggagtctcggaaaagttaaaagatacgcaggatatcctctcagaggccagattccgcctgctggacatgatggatgaggaaaaaggattcgcgtttgtggcgatcgggaggccggaatcatcgggatgctactgtgcgatcaactcctacttaagagacgtgatctccatgctggcaggccagtttgactatgtggtgatagacggggaggctggcatcgagcaggtgaaccggcgggtgatggaacaagtcactcatcttctgctggtgacggatcagagcagaaaaggcttgcaggtgatccagacgatcaaggacgtggcggaccgcctggtaatgtatgagaggctgggagtagcggtaaaccggatcacgcaggatgtgatcccttttggaaatcccttcccggatgcgccgtttgtagagatccgaaatgatgaagcccagattgtaaatgatattcaggggaaaagcgtgtttgaacttccggaggaatgcgaacttttaaaaggagcggacaggatactggatgcattgggaatttgaaaggaggcggtaagttcatgaaagatttgagacatctgtatgctttggaacagcagttgatggagtgtaacaatgatatggtgaaagaggcctgcgaaaacgggaagattgccgtgggggacgtctgtagcatgatcccggaagtactcttgaacctgcccggatgcttttccgtgcgtctgcgcgcgccgcgaacaggctctatagagattggcacatactacatgaccagccttctgtgcgagtattgccgagccctggtggagcgggcagtggaagggggctataattttctggactgcatcattgccccggatgcctgcgcggctatgaaccggtgcgtggagaatatagatcttctgaaaacttgcgaaaaagagaagttcttcattacgtattcggatgttcccatgaagtcggatgagacggcgcttaagcattatgtgaaacagatgcgcctaagagtgctggagcctcttcataacgtatatgggatagatatctcgcaggaagcgcttcttagcgcggtcaggcagcacaatagggtatgcagcctgatcaatcagctgggagaattccggaaggaagagaagccccgcattacgggatatgagttctatctcctatgtctggcaacctattgctgcccgaaggatgcgctgatacccatcctggaagagacgcttgaggaagtcaaggaacgcgagccggacgaggagaagccataccgcatccgcgtggtactggccgggtctgagattgacgacctggattttgtgaagctgattgaagacaatggggcgatggtggttgcagaccggcactgctttggttcttttccgggtagggaagagatcaaagtccgggaaggggaagatatgctgacccagatctgccgccactatatggtcaccgggcaatgtccgaggttcatgaatacagaaaagatcgaagagcgcaaggactatgttgacaggctggcaaaggaatacaaggcggacgggatcatctacgagcagatgaagttctgcgactattggggctatgagaggatggcggccagccatatcatgcacgaagaatatggctatccggtgctttccatcgaccgtccttatgtagtagggagttccgggcagctgcggacaagagtgcaggcctttgtggaaagcgtagagattaaaaagatacaaggagggagatagatgggcagaaagatcaacagtgagaagctgggcaggctctactgcggcaagaagaccaagaagcgccgggagtggagaggggcctcagatacctggtacgactatacgcgctgggtcaggaactgggcggtgatggcgaagttcatggcaaagcctgccaatctgaagggattcttccgttacagatggatgggcaattatctggcagtgccggattttgtggatcggcacacggaagggctgagagggcctcagcttaggattgcccatcaggagtttgactttatcgtggaacacgtatgcgataccataggaaatctgttccgggctgatccaaaatgtggaaatgatcaggagtttaacaagaagattgtggtgtttgatgaaaatatgatgtcccagatcatgaacggattcccaaaccttcacatggtatgccgggagatcccgattgtctacacgccttcgactgtagcccaggatggcgtcctgcactacattgatgtggcagaagaattcgggctgccttcggatgtatgcccgatgccagcggccgagctgggctgcgccattgatgacgactatccgctggtaggcgtatgtgctgtcaactgtaatactacctgtgacggaagcctgatgggaaatggcgtggaggcgagaagattcggcattcctactttccagctggcagtgccgatccgtcacatgcagcagagcgtgcaggaatacggagcggaggagattgccaactgcatccgattcatcgaagagcagaccggcgagacgttcgactgggatcattactttcagtgtatggagacatttaatgaagagaccaaattattccgggagtggctggatctttccaagacgaaccgtccgcaggtcatcggcaacaacgtagcgctttaccgggatgcctactaccaggtgggaggaggaagagacgcccgttttctggaaaatgacagaaagattacagaactggcatacgaaggatatgagaaaaaggtctcctgcgtgtcggaagtacgtcaccgggcagtactgtggggcgtccaggcgcaatattatacggcatttccgatctggcttcagaactgctggggcatcctgccgctgatcgacatgctgagcctgacctctacggaattatatagcaccactgatcggcagcaggcgctgtatgatatggcagacttatatatgaagatgaacatgagaaaccgctccaacggaggctatgaagtaggcgtggatgacctgtggcgcttctgtgaggaattccatgcggacatggtcatcatgtatgagcatatcgggtgcaaggcaatggctggatatcatgggatcttcgaagaacaggcaagagagagaggccttcatctgatctgggttacccatggcctgatggatccaaggaaagcaagccgcaaggacatgcgggacgaggtgagccggtatatgagaaccgtgctgcaggaagagccgctggatccgtctctggaagatttcccggatgagaataactggtaggaaggagtaagagggctatgaagagatattttggcggatgtgatgtggggtctacctatacgaaatgcgtgatccttgatgaggaaggaaagatggcagcccataccacgataaagagcaagatgaattcagagaaaagcgccaggactgctatggaggagacgctcagacagattcccggacttgataccccggaggatctggagtatctgatcggtaccggctatggaaggaacaaggtgccgttcgcgcaggaaaatataagcgagatcagctgccatgccatgggcgttcatgtgacggatccaaaagtaagatccatcattgatattggcgggcaggatataaagggaatcgcgatcgatacagatggcacggtgaagaactttgccatgaacgataagtgcgcagcaggaaccgggcgcttctatgagaccatggcaggcgcgtttgagatgtcgcttccggaattttccaaactgtccctgactgctaagaatgtcattccgattacagcgcagtgcacggtgtttgcggagagcgaagtcatcacgctggtgggcgagggcaagcccatggatgagatcgcggcgggaatccaaagatcggtggctaaaaggtgctttgtgatggcgaaaaaagccggcgctacagacagtgtcacgctgaccggagggtgtgccaagaatgaagggcttaagaaggccatccagcaggtgctgaagctgaaggtggtggatctgggcacagacccgcagttgatgggggccttaggcgcggccgagtatgcaaggcagaaaggcctggcaaaacgaaaggggaggtaaggatgaaagaacgtatttggaagatcgcaaagacgttaaccatcgtttcggctgtactgttcgtacttagcctgatcgtgtatttttttaatctggatatgaagctggcggcccagatgcagaaggcgatggacatggtatatgacagacgcaagagggaccgcaggctgtagatggctgccaggatggcatgcggacaggaaggagtgaagatatgagaccgctgataatgaaacttgcgacgaagataagcgtggaggccaaatcctatacgggcatcacggtcaatgacccggaataccggatcctggaaccggtggtgaccgacgagatggcagaggtggcgcttgccgcgaaagtccgcaagaatatgactgcccaggaaattgcgaaacgatgcaaaaagccgctggaggagacgaagaagcttctctgggatctggctgttgcaggcgtcatgcgcgtacatagtgaaaatggcacggactactatatgctgccgatctgggtgccggggatcatggagatgatggtggccaataaagagcaggcagagaaatatccggtgatggcagagtgcttcgaggagtatactcgcaggaggacccggctgcttggccccaatgtccctgtaggaaaggggctgatgcgcgtcattccggtggaagaggcgattgacggggagaatcatgccgccagctacgaggaagtatctacctatatcgagaatgcgtggaggctgtgcgtgtccgactgtacgtgccgccgttcccgccgccttatgggagagggatgcgggcatctggaaaaggatatgtgcatccagctggatgaaggcgccgattacttcatccgtaccggcgtaggacgggagatcacgaaggaagaggcctatgaaatcctgaagcgtgcggaagaaaacggactggtgcatgagatacagaacctggatggagaagggaagacggtggcgatctgcaactgctgcagctgctcctgcttctctctcagagtcggaaagtattacatgtctccggacttcaaccgttccaactatgtctccagcatagacgcagaaaagtgcgtggcatgcggccagtgcgtggagaactgtcaggtaaatgccttgcacctgggaagaaaactgtgcgcaaaaactccggtcccggaaaaggaaaaagatacgcctcatgaccacgtatggatgctggataagaagcggtggaatccccagttccggtacaatcgagatgagatagacgagaatgggaccgcgccttgcaagaccaactgtccggcacatattgcggtacaaggatatatcaagcttgcggcccagggaaaatacagggatgccttggaattgatcaagaagaacaatccattcccggctgtctgcggacacatctgtaaccgccggtgcgaggatgcctgttcccgtgccgatgtggatgagccggttgccattgatgagattaagaagttcatcgccgagcaggaactaagggaagagaaccgctatgttcctaagatgcagaatccccaaggggaaaagtatggcaggaagattgccgtcgtaggcggcggccccggcggattaagctgcgcgttctatctgcagcagcggggatatgacgtcaccgtctttgagaaaaacgacaggcccggaggcatgctggtctttggaataccggcatttcgtctggaaaaggacgtagtagaagctgagatcgaggtgcttcgtcagatgggagtagagttccggacgaatacggaagtggggaaggatatcaccatccgtgaactgcgaatgcagggatatgaggcattctacctggccattggggcacagggaggcagaaggcttggcgtggaaggcgaggatgcatccggcgtattatccggcgtagaattcttacggcagatgaatctacatgaggctttgaaactggaaggcaggaccgtcgtcgtaggcggagggaatgtagccatcgacgtggcgcgcaccgccgtccgtgctggaagcagcgaggtggggctctactgcctggaaagtgaaaaagagatgcccgcacaggaagaagagcagcaagaggcaaaagaagagggaatctccctgaatcacggatggggaccgaagcggatcctggcggaagacggcaaggtaaagggaatcgaattcaagaggtgtacccgcgtattcgatgaagagcaccgatttcatccacagtatgatgaagcagatacggtcatcgtggaatgtgacaatatactggtgtctatcggacagtccatccagtggggaaccatgctggacggcacgcgggtaagagtgaggcgtaaccaggctgcgatggcggatgagaaaacataccagacgggagagccagacatatttgtaggaggagatgcctatacagggccgaagtttgccatagacgccatagccgcgggaaaagaggcggcagaatctatccatcggtatgtacagcccggacagagtctgctgatcggccgtccggcgggcaagtaccatgaactggataaggagaatgtggactgggatagttttgaccatacgccaagacagcagccgaagaagccggatccggccaaggcgaaggaaacaatgcgggatctgcgggggacatttacggaagaacaggtaaaaaaggagacggaacgatgtcttggatgcggagcaaccgtggtggaccagaatgtatgcgtgggctgcggcatatgcacgaccaaatgcaagtttgacgcagtgcatctggaacgccgttatgacgcccatgaagtcccatatgagaaactgattgtaaaccacatggcgccgactttgatgaagcggggagcaaagatcgcggccaggaaggccaaggacatcacgcttagcagaaagagaaggcagaattgaaggtagaggcatatgcatgaacttggaatcgtatttagcgtagcggataaggtgctggaaatcgccagggacaatgaccttacagagattgtggccattaccatgcagattggggagatcagttccgtgattccggattatcttaagaaatgctttccggcggctgtggagagaagcccgatttttgagcatacagaactgaagatcgagattcttcctgccaggtatctgtgccacagctgcggagaatccttcagtctggcacagttcaaagaaagcggcggctgtccggcctgtagggagcaggatttcctggaacttctgaccgggcgggagtgttttataaagaatatagaagcatattgatcagattttaagagcggcacgacatcttaggatgccaggccgctctttcttagttaattttcttcaacaatccaggtattcctcagatattccggcatggcctcgtagaaaaggccggccaaatcctccggcgtcatatcctccggggtattgagccattcctgcagaatgcctacgcatccgtggcagtataggcttatggtatagcggtcacgcacgctaagcgaagtctggcccgtggaagacaagtagcatttctcgacgattccaaaagaataggaatataggaatccagaatgggcattctgtccggatgagcggaaggcacgccgatagtaccgggaatcctcggcgattcccctgcacatatgcagcaggaattccctccagctgcggcagacccgctggccgatcagccgttccgccaataccatggaattaaagttcaagacatcatacttgtcatggaaatatcggtagaatgtggactttgaaacaccgctttgattgatgatcatttccacggtgattttttcaaagggcatatggtttagtaattcattaaaggcatcgaaaatgcgttgccttgtataggaactgtgggtcatggcaaacctcccgtcaatcattctacggcagtaatcttaagtaatattataaatgataggagtcggaactgcaaataattatgtgcacagccgcacatttctgtgctatgattcgttaaataaagtgaaaggagggcttcatacatccatggatatagaagaacagtatgataaagtgtaccgatactgctacctgcggatccggcatcagcagacggcagaagatattacgcaggaagccttcctacgttttttggaggtccattcttaccgggagatagggaaatgtcttgcctatctatacacgatagcccgcaacctgtgcacggattattatcggaagaaaaaggaaatgccgcttccgcaggactatgaattggcgggggaggatgagcaggatggcctgatacagacgatggaacttagaaaggccgtaaaacagcttaaggaagaggaacaggaactaatcctgcttcggtacgtcaatgacgtgccaatcaatgatatcggaagaatcatgggcatctcccggttcgcggtttaccgcagattaaggatatgcctgaagcagttaaaagaagagttgggaaaggagggggattatgaagaaagagataaaagcaggacttaaggaaatatatgaagcgcctccgtcgcttaaaaaagatgaattccttcagaggatcggcgagccggaactgacccatctcgaattcctcaggatgcaggtacattatatccgcaaagggaactggctgatatcagtagtcttttttctgtcagcgctgtttgcgcttaggcaggcagaacttgaagtgctgtggcccatatctgcatttgtcccgtttctggcgttgtctgtggtagcggagaacagtcgttctttgagatatgggatggaggaattggaactgtcatcaagattttctctaaaggctatcgtaatggcaagaatgggcgtgatcggtttgggcaatcttatgctacttttgattctggcagcctttgtttggaggaggtcttcgcttttgacagccggggtctatcttctgcttccatatcttttggccacatttttgaatctcatgctggtgaggaaggtaagcggcaaggagagcatctactcttgccttggaattacgattctggcgagcgctgcctctgtattgccaggggtgatgaacatttctatcatggggctaatgcgctccggctactgggctgcgcttcttgcgggcgctgccatacttgcggggcgtgaaattaaaaaattattacaacagtcggaggaactggtatggaattaatcattgaccgattatcgaaacaatataagaacaagattgccgttgaccggatatccctgacgcttcatcagggcgtatatggacttctgggagcaaacggggcaggaaagactacgctgatgcgtatgctgtgcggaattttacggcctacaagcggcacggtcatgtttgagaatatggatgtatcaacggaagactaccgcaaggaactggggtatcttccccaggattttggatattatcctaattttacggggagagatttcctgatgtacatggcggtgctgaagggaatgacgaaaagccgcgcccaaaagcgatgcgcaaagctgctggatgaggtgggattaaaagaaatgggagataagaagattaagacttattccgggggcatgaagcagagactgggaattgcccaggctcttctaagccacccaaggatattgatcttagacgagcccaccgccgggctggacccaaaagagagggtgcgcttccgggatatgatcgcagcgttgggaaaagaaagcatcgtgattctctccacccacattgtatctgatattgaacatatcgctgaccggatattgctgatgaaggacggacagattattttcaatggaacacaggaggagatcggagaagatttagaagagttctatttgaagcagtttgaggaggtgggagaacatgcgtagtttctggttgctgactggttttgagtataagaaattatttcagcgtaagatcgtatggataacacttgcagttatgattgcagcctgcatccttctgtcctgcatttcctacatggctaccggttataccattgatggggaacctgttaatggatatgatctgaagaaaaaacatgtcgcccaggacaaggaagccagtggaaccaggcttgatgggaagacgctcaaaaatatggaggagtccccgtcagatattcccggcgggctattcaacatggtgtactatatcactggcggatgggaagttgatggcctaaaggaacaagaactataccagatccgtgagaacaatatagaggcaaattgggagagcgccaggctttccaagggagaaaaaaagtatatggcaaagcaggaagagaagattgaaaagcctctgacatatgaatattcagacggataccaggaggcaggcacgcagatggtatttgtcgggctgctgcagacgcttctgattgccatctgcattccatccatattcgcggaggaacatataagaaagacggatcagttgaacttatgcacgaatatggggaagaagacgctgtatctggccaagattgcggtaggtatttccttttcgctggcggccacggtgattctggctctggcaataacaatccctacatttttgataaatggattggaaggatttgatgctccgattcagtcttttgccccgctggagtcatgggcgatgacagctggagtacgattgctgatcatgatggcgatggggcttctggcagcgatcctgcatagcgcggccggaatgctgatgtctgagaaagcaaggggcaatgtagcgccgatggcggtgatggtaggatttatgctggtatccctctttgtaaccgtaccggatcagtaccgagcgcttgcgcaggcctgggatttggttccgggcaatgtcctctccgcgacaggcccattcggcgtgcggctgttccagatattcggaagatatctggctgcctggcaggtggtgccgtttgtctatcttgcggtcgcggcagcatgcatcgtactgggtggccgcttatataaaaactaccaggtgagcggcagataagtatatttgctcatatgattcggggattctgcattttgcagaatccccgtttggtattgaagaaccaaagaaattatggtagcataaaaatcaaatcagacattcttttttattctatggcagatcgccgattaatccaatgttatgatttcaatccaatgatgtcaggagggatgcgcttgcgtgtgattttttgactttttatctgttaagagacttttgcttgtgataagatgaaagaagaaacctatggacaaaaaacaaaacttaataccattgcaagagttgaaccttaccagccgcttcctgttcgacgaggtgccccgggaactggcagagttcctgcattatctggaggaaaccacggatgagagggcggcaagtacggacagccagcggatcaagcggatccatagacgggtgcgtaaggttaggctcagcgaggaagtcggggtgaagtatatgcaggcttgggaagagagatattatgaaagggaagaaggaaaggaagaaggagcgcataataaattaagggaactggcggcaaagaaatatcgcaaggggatgtctgtgaaggagattgcagaattgcttgaagagagtgaaacgacggttcaagaactgctaaaggagtcagagatgagatgatctaatttcaagaatgtcatattgtggtagagaactggggcagtatgagttataatggactcaacagtagttttcaggagggaaagtcaatggaaaaatcaaaagtatattatacgaatatgaaggcaacgttccaggagaatcttccgcagaagttaaagcgcctgatcaagacagcaggaattggggagattgactttgaaaataagtacaccgcaatcaagatgcactttggggagcctggcaacctggcattcttacggccgaactatgcggccgtagtagtgaatactgtgaaggaactaggtggcaggccatttcttacagactgtaatacgctgtatgtcggtggcaggaagaatgcgctggatcatctggattccgcgtatcagaatggattctcgccattctctaccggatgccacgtcctgatcgcggatggattgaagggaaccgatgaagtagaggtgccgatagaaggagaatatgtaagaaatgccaagatcggacgtgctgttatggatgccgacatattcattacgctgagccattttaaaggacatgagtctaccggatttggaggcgcgcttaagaatattggcatgggatgcggatcccgggcgggaaagatggaaatgcacagcgcaggcaagccttacgttgaggtcgagaattgtatcgggtgcggcaactgtatccgggtgtgtgcccatgatgcgccgaagattacagataggaaagcctttattgaccatgacaaatgtgtaggctgcggcagatgcatcggcgtctgtccgaaggacgcagtctgtcctccgaacgacgagtccaacgatattctgaataagaagattgccgaatacagccttgcagttgtgaagggaaggcctcatttccatatcagcctagtgatcgacgtatcaccgaactgtgactgccattcagaaaacgatatcccaatcgttccagatgtgggaatgtttgcgtcctttgatccggtggcgctggatcgggcttgtgcggatgcggtcaacaggcagcctgtgatggctggaagccagctggatgacatgccgcatacacatcatgaccatttcatcaattctgccccggaaactaactggaaggtgtgcctggagcatgccgaaaagatcgggctggggacacaggaatatgaattagtggaaatctaattgggaattcatatctcgttatattttacataccgctataatagaagccgggcctatcaggcacgaaatccttcgggattttgcacctgataggcccggcttctacattgggcgctgtcttcagcagcaaagaggtccagaataacttaagataaatgaaagattttttgtgggaggagtatggtattatggagaggatagagaatttgacttatgttaggggcgtggaaagatgaggatattattggtggaagatgacagggagatcagcgagatgctggaggaatttctgatacaggaggcatttgaagtggtcccggcttttgatgggctggaggcatgtgagaagtttgaagacggggaattcgacctggttcttctggatctgatgattccgaagatgagcgggatggatgtgatgaagacaatccgggagaagagcgtggtgccgatccttatcgtatcagcgaaggacagccttctggataagtccctggggctggaactgggggcggatgactatataaccaagccatttgtgatggctgaggtgctggcgaggatcaaggcaaatcttcgaaggacgaaccagtatgcggcgggcagcagtcggaagcaggaagagccggcgaccttgtcttgcggggacatccagctgaatccagctgatttcacggtgcgaaaaaggggaaaaaagattgacctgaccgcaaaggagtttgagatattgagactgctgatgcaaaatcccaagaaagtgtataccaaggagcagatttattcgctggtttgggaagatgcttatcttggcgatgaaaatgcggtgaatgtacatatcagcaggctgcgcaataagattgaggatgatgcccgcaacccggaatatatcattacggtgtggggattcgggtatcggattggagggtaaggatgaatggaatgatcatagggattctggctgccatctgtattctattggcagcggtatctgtcagggaaaacaggaaatataaggctttagaagataatgtaaagaaagtggcaagccagatggaacggatcctggatgaggatacggatgaaaaggtgatggaatttaccgggagccgggaagtggcaggactgatcatgcaggcaaaccgaatgcttaacgaccggcagaggatgaaggcagagtataaaagggcgggcatagaagcaaagaggatgctatctaatatttcccatgatatcaagactccgcttaccgtaatccttggctatcttgagatattgatcatgaatggggcaggcgagacggcgacgcttttaaagatacagaagaaggccagccagctgatggaactggttgaagaattctttacgctatctaagatagaggctggcgatatggatcttggactgtccaagatatcgctgagcgagatctgccggcagagtattgccgatttctacagcatattgaccgagcggggcacgcaggtggagattgagattccagagagagacatctatgtatatggaaatgaggatgccatccgtagaatcctgtttaatctgattaccaatgccatccgctatgggttagacgggaaatatcttggcattttcctgatcccgggagaagaagaggtggaaatacgcgtcagggacaaaggaaaggggattgataaagaaaacgccgcgcatgtgtttgaccgcctgtatacgatggaggactccagaaataaggaaatgcacgggaatggcctgggactttccatagccaggacgctggcgggaagaatgggaggggatattacccttgatagcgttccgggacaggagacggtatttacattgaaaatgaaaagacatcattatctccagtaagacctgccgaaagaatttcgtaagaattggtcaagagttttgaaaaaagaatccggtatgatagacctataaagaaaacgaaaggaagaagagacatgacatacgcattagaaacacataatctgacaaagaacctctcaggcagggatatcgtatcggatgtaaatatcagagtgaaaaagggggagatctatggattccttggccctaatggagcggggaagacgtcgatcatgaagatgatcacgaatctgtggaagccgacatccgggtatattaccgtgatggggaagccgctgaatgacaattcttatgacatccttaagaggatgggaagcatgatcgagtatcccacattctacgacgggctgaccgggaaggaaaatctcaagctgcactgcgaatatatgggctattacagccctaactgtattgccgatacattgaatatgctgggcctggccggagcggaagacaagaaggtgcgcaattactccctgggcatgaagcagagactgggaatcgcaagggccgtcctggcaaagccggaacttctgatcctggatgagccaaccaatggcctggatccactgggaatgaaacagatcagggatctgcttcggatgctgtgcgaagaatatggcattacgattcttatatccagccatctactgtcagagattgagaatgtcgcccatacgatcgggatcatgaatcacggcaaactgcttcaggaaatctccatggatgccattacggaccagaactttgcctatatcgaacttttggtttctgatgtgaaaaaggctgcctatgtgttggatgaaaagcttggcatcaataactttaagattattgatatcaatgtaatcagaatctatgacgtcagcatatccgtggaaagagtctcaaaggtactggcggagaacaacgtaggaatcgaaggcgtaaccaagaagcaggacaccttggaagattatttcctgaagcttacaagggaatagggattaggaggaatcaaaatgggaaaattaatcaagcttgagtgggaaaaatatgagataggaaaatatatacgcaatgcggcaattctgatcgtgcttctggtgatctttaactatgccatgacatttctggggatcgccaatgacccggatacaggagtgccggatatggcaatctccaatatgggggtatctaccaacgtagaactgcttacagacataacgttcctgatatttgcggcagccatgcacgccacatttatcatcggggcatataagaataagaccatgaacctgatgtttctttatccgttaaacaggaagaagattatggcggcgaagatgctggcagtctgcattttctgcttcgcaggcatcgtgatagcaaaattagcctgctatggagtcagcaatctgggcttcatgatgggtcagaaggcatcctttccgatggattacaatatgctaagcgtctccttctatatccagctgcttataaggtctgctgccaccatcagcatcagcctgctggcgcttttgagcggaatgatagcaaaatcatccaaggtcacagtcatatcatccttcttattgatcatcctgatgcagggaaacgttggcggcgccacgttaaaagacaatttggcggtgccgatcgtacttctggcgatatccgtgctggctgccatactgatggtacagagggtggagaagaaagacgtgatgtgatttatcaagaaatagtgattcgtcatgtatgagaaaaatggtcttgacagagcaaagcaaaattagtattatataacagtgatatataacggtgttatagatagaaggagaaggcaaaagtgagcgaagcagaccagaccacgttggaattgatccatggagcaggaatgcgagaatttcttgaaaaaggctataaatccgcatctttaagaaatatcgtgaaaacagccggagttactacaggtgcgttttatggatattacgacagcaaagaggaactgttcgaggcattagtaaaagatcagtatgattggtttttagactgctttcgcaatgcacagcaggagtttgccgatttgccgcggcagagacagccggaaaacttaagtaccgtttcgggtgaatgcatgcacgaaatgttgctgtatgcttatgaccatttggatgaatttcacctgatcctctgtcagtcggagggaacccgcttttcaaaactgatcgatgagatgacagaaatagagacaaaagcaactcatgactatctgcaggtgcttgcggaccttggcaggcaagtgccggaaattgatgagcatttggagcatattctgattactggcatgtttaataccttttttgaaatgatcattcataggatgccgctaaagaaagcgaaacattatctaaaagagatgcgggctttctatactgcgggatggatgaaaattatggggcagtaagccctataatttttaaacgttagttagcgtatgctaactaaagaggggtatctgagaaaagttttttctttatatcataaaatttaaggaggttttatatgaagaaacaatcaaatttatcaagattgatgggttatgcggggaagcacaaaatcctgacttatctttcctggattttgtcggcagcaagcgccttgatcgcccttgtgccattttactacatttggcgtattgttcatgacattctggagacagagccaggcagtttgcaggcgcagaaacttaccggctacggctggcaggcagtaggcttcgctgtgctgtcggtcattatttacattggagctctgatgtgttcccacttaagcgcattccgtattgcttccaatatccgaaaggaattgatgcggcatattacggcgctgcccctgggggttgcagaaaggtacggaagcggtaaacttcggcggattgtcaatgattcaagcgcggcaacagagacttatctggcccaccggcttccggataaggcgggagcgattgcgacgcctgtcggcctgttggtcctgctgttcgcctttgactggcgcctgggggttttaagcctgattcctgtcctgctgggatttttgatcatgatgagaatgaccggcaaaaacatggaagaaaaaatgacggagtatcagaattccctttctgacatgtctaatgaagcggtggaatatgtaaggggaattccgattgtaaagacgtttgggcagaccgtgttttcttttaaacgttttaaagcgtctatcgacaattatgaaaaatgggtgatcgcatatacaaaacagctccgtctgcctatgatgttttatatcacggcaatcaacggcgtatttgcctttctgatcgctggaggagtattagccaccaggaatggcgtgacgaatgaatttctactcaatctgattttttatatcgttgttactccggtaatcggcacgacgctgacaaagatcatgtttatgagcgaggactctatgatcgtggaggatgccattaaacgaatcgacagtctgctttgcgaaaccgtgcttccatatgaggctgtccccaagatgccatccgggcactcggtcgcgctggaacacgtcagttacagttatgatggcgtaaaagatgccctaacggatgtttctttatccatagcgcaaggacagacggtcgccctggtaggagaatcaggaggaggaaagactacgcttgcgaatcttgtagcacggttttttgatcctcaaaatgggcgcgttttgattggaaacacggatattcgcagtattccgaaagaaattttgatggatcaggtatcttttgttttccaaaatagccatttgatcaaagcatccattctcgagaatgtacgtatggcaagaccggaagcgacaagggaagatgtgctggaggcgctcaaagcggcacagtgcatggatattattgggaaacttccgaagggaatcgacactgtggtgggaacgaaagaaacctacttatccggcggcgagcagcagcgtgtcgccattgcgagggccattttgaaaaacgcgccaatccttattctggatgaggccactgcatttgccgatcctgataatgaagtacgcgtccagaaagcgctatccacgctatcgcaaggcaagacagtgattatgatagcgcacaggctttcttctatcgtagacgcagactgcatctatgtactgcaaaatggagagatcgctgaatgcggcacccatacgcagctggtaaagaaaaaaggtatttttgcccgtatgtgggaaaattattcccaagcggcaaaatggaagattgaaaaggaggtacgtgtatgatcggattgttacagaggcgttttgctttatcaaggcagggtgcgattgacttaatcaaaggctgccttgcctgcgtggctcaggatatttcttttatgctgccggtgggcctgctatatcaattcgtggtagatctgatggggggtaggcttagtggagaaaagcttgttttttatggggcaggatgccttgcttgcctagcgcttatctttgccgcgacttattttcaatacaatgccacgtatctggctacttatgttgaaagcggtgtgcggcgtatctctttggcagaaaaacttcggaaaataccactttcattcttcggcaagaaagaccttgcggatctgacaagttcgatcatgggagactgtgccacgctggaaacggcgttttcgcattatgtgccggcactggcgggttccatgatttccaccaccctgattgcgattggcttgttttcctatgactggcggatggcgcttgccgcggtctgggtactacctgtagcctttacaattacttttttttctgcgcgcatacaggagtattttaacaataagtcggtagctgcaaatgtagaagtagaaaatggcgtgcaggaatgtatcgaaaccctgcaagatttgaaagcgaacaatgcggaaataaattatttaaagggacttgagaaaaaaattgattacgcggaaaagcgtcacatttttacggaactgggaacagcgctgtttgtcgtatcctcaactctgatattgaagtttggaatctctacggtcgcgcttgcaggctctgcactgctcatccggggagagattgacatcccgatgttctttctattcctgcttgtggcctcaaggctttatgctcctcttgaaggcgccttgcagaatcttgcagcgattattgctaccaagaccaacataaaccgtatgaacgaaatcctagatcatccggttcagacaggaaatgccgttttgaccaaccagggatgcgacattgtattcgaccatgtaggatttgcatatcgtagcggcgagacggttctaaaggaggtgtcctttacggcaaggcagggagaagttaccgccctggtgggaccatccggcggcggaaaaacgacggtatcccgtttggcagcaagattttgggatattgataaagggaagattacagttggtggcatggatgtcacgcagatagagccggaatcattgctgtctctatattctatagtgtttcaggatgtgacgctattcaataatacgatcatggaaaatatcaggattggcagaaaagacgcaacggatgaagaagtgattgcagcggcgagacttgcgaattgtgaagaatttgcctcgcaacttccggatggctatcagagcatgattggtgaaaatggctgtgaactctccggcggagaaagacagcggatctcgattgcacgtgcgtttctgaaagacgcgccgatcattttgctggatgaagccacggcaagccttgatgtggaaaatgaaacgctgatccaggcagcattgtcacggctgattcagcacaaaactgttcttgtcatcgcccaccgtatgcgtactgtaagcggagcagataaagtcgtcgtgctagcggatggcgtggtggcagaacagggaagcccatcggaactgatggatacaggaaaaatctattcccatatggtagaattacaggccatgagtcaggaatgggggatttaggggagggtttcccttgcatatttcttgattgcagcaaaagatttatcgctgatgtcatgttcaattttacaggcatcgtctgccgctgtcttttcatctacgcccaaacgcactaggagttcggccagcagggtatgacgctcgtaaatctttgccgcaatttccgtcccaagcttggttaaatgaagatgtccctcctgatcaacagtgatatatcctccctgctttagaagcctcactgcacggctaacactaggcttggagaaattcatatattcggcaacatctaatgatcggacggcactggttttctgagagagaatgtaaatagtttccagatacatttcgccagattcttgtaaattcatagtttaggctccttttatatataaatataggatatcaaaaagatatcctaaaatcaactaatgaaaacggcaagaatactgttattgtagccggcaaatctcagaaggcggtctttggcgtagaaatcagaaatggggcaagagacaagggccgccataatagtcgaacagagagtggagagaaagatgaaatatgatttatcaagaatttcaatattaattgccaagattcattggatgttataatatatctgtatgcgaatttgagaacataagaggaaaatatatggatatattaaaaaagttttggagaagcgtcaagggtaaatgcctgatagccgtcctggtcttactggcagcctttgcagtgcataatgcattggagggaaaggaaggcgagaagcagattacgcagacagaggcaagaaaaactaaaagagaagtcgagtatgctaagccagtggatgatagcaatcagatacttgggaagttcaaggaacaatttccggaagcttccgtagtgctagcctgcgaggaagatgtaacggacgatggatgtaaggatctgatcgtgatctatactgagaaggaacttacaaggacggtggctgtgatagacagcggagacggagtaaattataattttaccacgccgataccggggccgattgaaaaccagaaaatacagtttaagaatattgataaagaaggagagatcgagataatcgtaacaggagagaaaaagggagcggtaggctatgccatctaccgtatgattgatggagaaatggtcgatctgtttggggaaggcatggaagactgctgctagagtgcaaaaaggggatgttatcgcatcccccttttcattctttgctatttcatcttacaggaagaactgatatccctttccccataccgtacgtatatggaatggctgggaagggtcgtcctcgatcttgccgcgtagttttttgatatataccagaatcgtattgttgtcggaaccatcatttttccaaacttcctgaaatagttcctgtttcgagaatgtatgtccgggatgatccataaacaggcagagaagggcgaattccttggaagtaagcgcaatctctttcccatgcttaaatatggtctgagaattcatatgcaaggtaaaaggccccttttgtataggcgactgtatgctctctgcagttgtgacgtattggcgtgtgcggcgcacgattgcctggattttggagacaagcacagtcttgctgaagggcttggtgatataatcatctgcgccaagtcccaggccctccacctgggctgcgtcttccgttttgccgctgagaaggatgacaggcgtatagatcctgcgcctgcgcagttctgccagcaggtcaaagccgccctgctccggcatgataacatccaggagaatgatatcaaaggtattttccttgaggatatccagggcaagctgtccgctgcccgcacaggatacgtccatttgctcgcgctttaagactgcgctgacagccttctgaacggcagtctcatcatcaatgatcaggactgatatatttgacatattgttacacccgtctttctgctataatagccataggtagattatatctgcctggaattttaaagtcaaccgtcgaaggagcataagatgaagaatggaaagaagaccagacgaatacggatatggattacagcggcagtcacggcgctgattctattgattgcattcttctgctaccagaccgtcaagaagacgattgtcaataacgagaaagaaagcatggcaggcattgcaagagtaagcgcccatagtcttgagacgagccttaaggcaaagagcaatctggtatatgcggcgttatccggagatatggacaatgaagaagatatccagcagaatatgctaaagacaggcgagaaaagcagatatatcccggaagataagatggaggctttaaaaaaatgggaggaagaggcatgcaaggaagccgggacaaggcccggagaggtaattgcagggccggtctgccatcaggaggaaggctactacgctttatatttgacgaaagccgtgtacatagacagaagtcttgcaggatatgtgcaggtagaattaaacctggatgatatctatgaagaagagcaggcattgtccaacctgaaacttggaaatcagggatactgcgtggtaaaagaggctgacgggactacggtcatgtcaggagggcatggggaggcagaagaattttccctggcaggggatgaaggcgatggatgccgaatcgtctggtcctatcaggttcggcaggggactcccgaacgcacgcgcaagctggttgcctatgactcggcagaattcgcgggcgagaaatttattttatgcattatagaaaactatgacagtattgtggagcccatagacaggatcgccctttatctttccgtgctgggtctggctctgctggtatggcttggcatcttcttatgccgcatggcagagcagcacagggaagaggaaaaactgaagatggaattacagcatgaaaaggaactgaatgaagcaaataaggcacttgagaaccaggagaatcttatgcagaagtataatcattcgaaaacaatgacggtgctatcaggggccattgcgcatgaattcaataatcttatgacgccgatcgtactgtacagcgaattgctctgtgaaaatgaggaggtacaaaaggaactggcccaggaggcaaatgaaatgtcggatgcggtcagccgctgcgaggtgcttgcgcgccagcttttggaatatagcaggcaggggagggcaaagaaggtaatgaccgtctataatgcaactttcgcagtcgaaagcagcgtaagaatggtagagcgcctgattcccgctaatataaagtttgagacatctatatgcaggaccaaatactatatcaagggacagataggagccctcaaccagattatactgaatctggtaaccaatggaatgaacgcgattggggagaaatgtggaaagataaagatacagttcggactgagcacgcaggatgagcgcatggtcaggcttgtggtagaagacgatggaggaggaataccggaagagatccaacagcgaatttttgagccattctttacaacaaaggaggaaaaggagggcaatgggataggccttaccgtcgtcagacggctgacggaagagcatggcggagtcatccgcgtaaaaagccggacgggaaagggaactacattcattctggatttcccctggatagaaaacagccaagaataaaagaaatccggccatcttgattaagaggccggattttgttttattcataggtttctctgtcttttagatctttattcagataagaggtggctgtatcggcgatatccactgcttccttctctgagatattgtctatttcttttgctttattataccagtcttcaaaggtcatgccgatcggcatcaccggatcaatgctttcctttataaatgactcgaaatcatcgacgcctgcatcctcggatatctcggttgacataaatttgctgacgtcatttactttaggaatttcttcttccggtatctgaggatactgtgtgaaataatgttcataattctcaatattctgttccgtaaaatgccaggtgatggtacggccttccgctaccgtcttcatgtaaatcgtgcgcagggcaacgtatggatcaacgtcaaatccgtctgcaaacatcatggcggcattgtaaggatgctcgtacatatatttgattgccagctggtgggcgtatacaagccgtcttgcaagttccgggtgattgtctttgaactcgttggacatagcatagatgcagcaaagtccccatgtgtcggcggttgattcggcatccacgtcagcggcgccccagccaattcccatgatctttccaaatccttcaaattcagcgatggacgcataaggatcgcagcaggtaaatgcatcgatctggcccgcttttaaggcaaagcaggcatcctgctgccccatatccacgatgttataactgccggcatctgccgggattccaagtttctcggaccatgtaaggaattccgggtcaatttctggggtggcggtcattgagccaatagtctttccaaccagatcctccggcttttcgatatcattgcttacgaccaggtagcgggagcctcccatgtggttcgcggcggccatgcagaacggagcccccttattgactgccaggatcgcgccttcgataccggtgtagccgacatccattgcgccgcttgtaagagcctttaaggtttcggcggatttggtcacatttacattaagccccatggccttgtagatgccagccttttcgccgataattccggcaaccatatgatcgcagttgaaatagcccatttctacggtatagttcttctcctcttctgacagatcgccgaaatcgaaatccttaaccgcttctttgggatcatatcccgtggcctttacatccttggtagcggtctgtgtgctgctgtcgtggcaggcggtgatcaccggtaccagaagcgtaacaacaagaagagccgctagaaatcttctcttcataattcttcctccttgaaaatattaatttttgttaatatttggtaatatgataataccagaaggcacgccgaatataaagttgacagtctcaatatcgcaatttcaaataaataagcagataaatataggaaatgcaaataaaagaagacagtccgcaaaccgtcttctataaatgctactgtaataattcaataaaggcacccagacgggtattgatctgtgcctggtcggatggagaatagtcggtattgatggcaatataaggaatgtgtttttcctttgtgacgaaggtcttgaccgcatcagactctatggcaaatgtatggcaggcctgcagaagcacctccacgactccatccacctgatattcatcgatctgaacatcaagcgcttccagccttccgggattcggactcatgacagagcagtttacccggagatatttttcggcaatcgcagtgatcggatctttcgtttcgtcgatgggatcctttttctcgcggggaccgcagcagttctcgaatcccacaacgtccgcccccagttcctcgatacgccgtatgattttgtccattacgccggtagtcgggcatccggtaatcagaatcctgggcctggatggcttgcctttatattcgcgttcgtacaggtcctttaattcagcggtacgcttttcaaggaaagcgatcttttcttccaggtcaggggaaaactcattggaggagataacggtactgatttcgtagccggtgattggggaaggcttgagccttgcaacctcgaaaaagtcaaggacggccttgcgttccctgtttcttaagcgaatggcgcttcgaagcttgtcatccgttatctctatgccatagaactgttccagatcttccttcacgctgatgacttcctgcttccagaattccaaggctccgttgccggtctttccaggcggaagctgcatgatatggcaatgctttaactccctcatcaattcatacattttcttctttccgtcacaggtcgtctccgcaaggaccatatcggaaaaatagaagaatggacagcgatccgtaacggccgcgccataacttgccttgatcagcggacataggtttttgggaagcctgatctcggcagccggaatattgtcatctccgatgccgcatagcaccacggctaccgcatcggccgcgttgatcagttcccagggagtataagtacagaagacccccacgatgcgccggccttgctcttttagttctttcatggtaagaaatgcttttttcctggcctcagggtaggtctcgaaatgatccggcagaacgaattcaggcatataaaatacctcctttgtatttagtaagattcattactagatattatagaggagattgtcatgaatttgaaatcgaaatagtcaataactatataaatacaatctattagacataacttaaaaggacttttaaaataaaggaaaggacttacatttttggagaaaagaggaagcatatgcgcctggagtacataagaagttttatcagtgtcgtgaactgcaagagtttttctgtggctgcaaaacagattttcttatcgcagcctacgatcagcacgcatatcaagcaactggaatcggaactgggagtccagctgctggtgcgttcaaccaaggatgtgattctgtccgatgcaggcgttatcttctatcccttcgcaatgcggcttcttgaaacggagagcgaggcgcttgcacagatacacaagaatgaaatggaaataaaaggaaccgtgtcaatcgctacgtcttcggttcccggcaattatatccttccgcagttttttgcgtattcaaggaaggcatacccggatatcaattacaggatatccgaaggggacagcgccgaggtactgcagtcaatcttacattttgagacagatataggaattgggagcatcagaagcaataatgacaaatgcatgtgccagccattggcaaaagacaggattgtacttgcgacgccaaatacggaggaataccagaatatgaaggggaagtttcctatcgacaggctgaggcaggagacgtatgtgctgagggagtcaggaagcggaaccaggcttgcctcagagagtatcgagcgggcgctgaatctggataccaggcctttaaaagtggcgttgcaggctgaaaccagcgagatggtaaaaagaggagtggagcagggaattggagttgcattcatcagcagccttgcagttaaagattcggtcgcgcaagggaagatattgaaattcgagtttccggagatagatacaaacaggcagttatatctgctgtaccacaaggataggatgatgacgcttccagtgacgagcgttatcaagatcttgagacagttctgccagaatatatagattgtttggacgtaaaaagacagatctcttagagtgcagatctgtcttttttgtttcctgtattttctgcgatagcaggcaatctggtggccatgcctctttatgctatctattgagccctccatttcagcaggaccttttctgccaggaccatcaatgtgtcaattaagaagccgatcagtccggcaattaccatataggcaattactttttctgtctgcatctttgcctgggcttccaccatgcagtagccgaatccggcactggtcgcgatgaactccgctcatatgacggacatccagcccagtcctacggcaagcctgagtccggtcagtactccgggaagggagccgggaaggacgacatctttaatgacgccgaaagtattcgctcccatagaccttgcagcatgataataatctttgctgatgtcctgcactccggatatggtgttcagaatgatagtgaagatgccgctgaatgcaatcaggaaaatggttggcccatctccgatgccgaaccatacgattgcaagaggaacccatgccataatcggaacctgccttaacgaattcataaaaggagacaaggcctttagaatctggggggagtatcccatcagcatccccagagggaatccaatgatgaacgcatagagcgatcccgttagtactcttctcatggttattccaagattgcgtagcacgtacagatccgtaagagagaatcccacctccttgaacacatcttccagatacggaaacaagaaaggcttatctacaatgtgtgcagcggcaaaccagatgatacagatgactgccagaccgataagcgccgcgacatttcggttcttgcccccgaatttgcgccatctgccccggtcgccggcattcgtggcggctcgcatccgatctacctgctggtcatgattttcttccaatatatttcctcctttcttccaaaatcagtaagaaaatcataacaaaatcaataagcggaaagtaggattattaaggaataaaatattaatatttgttaatattaggatttttaataaagaaacaaaaaaagcagatcaacagatataatgaggttgcttgtacaaatatttaatttagaaaagggtgggaaaatggagaaaccatgtattgaatatatcagcgcatgtgcatgatgcgaggtgtttggggacttggttcaagttctggagaaggaatatgagggcaaggtgcatgtaaagatataccgtgcaggaaaagactttgactatattccaaaatatggggcggttacgaagagcatgctggtgatcaatgaaaagaaagccgtcacgaagcttacaaagccggcagtgcgcaaagcttttaaggaggcgctggagtcatgctagtggattttggaaattttatactcaggattctgaattcttcatggaatatgctgaatagttcatcggggtggatgatatttagttttatcgttgcaggagtgctgcatgaatttttgaagcctgagaaagtacagaaaacggcaattggatcatcgagggtgagcggcgtcttttggaccacgatatcaggaatgtttattccgatctgcagctgtggtacgattccgcttggaatcagcatgtattatagtggcgcgtatctgggacctacgcttgcatttatgacgagcacgccgatgatcaatccgattgcccttctgcttgcgtttggccttttgggcaaggaagtggctatcatatatctgattaccggatttgtagcgccgatgattatcggaattgtagcaaatagatttgccaaagatgaactacatataggaatgaaaaggcagaaagatgaggcggcgattcagatcgataccgatgaggaggatggaagcgagcccatgatacagctggaattcgaggagccggggttctgggagaagataaaatcagggcttcgctggtctttgacggaactcagcgtgacgatcagcaagtataccgtaacgggtatgctgatcgcaggcgtgctgtttaatatcgtgccgcagtcttttattcaagattatctggggaatccagggttcgtatctttatttgggattacggtggtcgcggcgctgatgtatgtgtgcgcggtcgggcatattccgtttattgccgcattggtggcaagcggcgcggcgccaggagtggccatcacatttctgatggctggagccgggacgaacattccggaacttcttaccataagcaagacgatcgggaagagagctatgtttatgtattttggaatggtggtggttatttccaacattgtcggctatattacaaacaggcttctgatgccaggatttacgccggtgctgaattatgatcagacacagcatactatatcctatgcgaataaaatgatcgtagtcatgccaggctggatacagaatttatgcagcggaatacttgtatgctatgcgctgtattctcttttcaaaattatcaaaggcaaggccggaaagcagtgtgtggcataagtcatgaagattcagagagcaatcgttataatgctgatcgtctttttggcagccgggcttggagcagtattgttccttccaaaagaaaagcggtggaacaaggaggctgagataaagataggcgccggcgatgatatatcaggagttttaatggatgaaacggttgaggcattaaaggactataaagtttccagaacgcttcagagttcttcttttcaggattgctgtagcaatacggcgcagtgggcaatgaatgccaaggagattaatgtgggattttactgtacccatattgccaggcatacggtgatgcagaatcaggatgtagagatatatggtccagtgattatgaacggcgagactatcgtatataaggaacactgggagaatgtagagaaccttgcggtgacgcagggcagagaaaaatccaaggtgctggctcaggaaacgtatccacagatccagggattcaatgagattacccagaaaggaatcctgtacgcattggaggatgagcaggtagacgcagcgatcctggacattacgaaggcggctaaagtgccggattatcagaatatgccgctgtcagatacggattatatatcctatgtactggtggtagataaggaattcgaaaagacagaggcattccaggattttatccacagttataaccgggcggtatcgcgtttgagcaatagcggctatctggcccgggtgatgggcgtaaaagaagaatggctggaaaataagaatataaagtttttaacattagaagagacaggagtagattagaatgtcaatttcagtgcagggaatttcaaaaagttttaaaggaagaagaaaaggcgagccagaaaatgaagtattaaaagatgtgaactttgaagtggaagaagggcagttcgtatccttgctcggaccttcgggatgcgggaagacgactacgcttaccatcattgcggggttccagaaggcgacggacggagtcataaaggtcaatggcgccaaagtggaaaaaccggggccggacagggcgtttatgttccagaattatgccttgtttccatggcttaaggtgggagagaatattgaatatcctatgcggaagatgaagataccgaagagccagagaaaagagcggctcaaagaactgctggaaatggcgcagctgacggagtatgagcattattatatccacgagatatcaggaggcatgaagcaaagagtggctctgctgcgggcgctggcctgcgaccccaaggtgcttctgatggacgagcctttaggggctgtggatttccagatgcgccagcttcttcaggtacagttagaaaacatcctgggacaaaagaagacgacatctcttatggttacccatgatgtagatgaatccatatatctaagcgaccgggtgatcgtcatgtccagaaatcacggaaagatactggaagacgtaaagattgaccttccaaggccaagagaccgcacgacgccagaataccatgcatatgtagaccatctgaccgagatactgaagtctgcattggatggaggcgtatttacccaggaggacaaggatattatggaatttatccaaggcgtggagagtggaaaggaaccgcttagggaggcgatgggcacatccgcataattgagagaaaggataatggagacttaggaaaatggatcagaatatacataaaaaatttaccgaaaggcagaatgaactgagattatatatcattcagtttattgtggatcatcaaaggccataccatctggatcaggatatgacgcagacgttaaaagcgcttgggatggatcaaaaagaatatgaggagattatagaatgcctgctaaaaaaggatggaatggtaatcgatgaagagaggaatgtaaactttatttatccggtatccgcactgcagaccagccaccatgtgacccttcaggatggaagggagtttacggctatgtgcgcgatagatgccataggcgctgcatttacgttccatcaggacacggagatacattctgcgtgcgcttcctgcaatgagccggtacatataaggatcgtggacggaaaagtcgcggagtattcaccaaagaatctgcatgcgttgacgttcccgctgggggaactttccaactgggcaggatcctgctgaaatgtcatgaattttttctgcagcagtgcagaattcgaccaatacgttacggatatggagctggatgctgcttccgtgattaaggcagacatggatagagcagtggaagaggcgaaagcgacatttgaagtataaatagaaaaaacaggaggtacaaaaagaatgaaagtagcttacttattggaatcagaacatgcaagggaaattcttgaaacgatgattatcccgcagttagaggaagaccgccatggcgcagaggtggcaggcatgatgtttttctttgacaatgcctatatgctggtagagggctgtgatattgccgccaggctgcaggcaataagcgagaagacaggcatgctgcttatggcctgcgaccgctgctgctatcagagggatattgcggataagcttgtcgcgccggcaggaatcggctgtttccctaatgtatacgcagcgcttgcgccagccggcgttgatcaggtgatcacattataaggaagacagggtgatgtccatctaccttttgggtaaacagtttatatagatggccattgacgggggcatccttgcagaaggcaaggatgctttcttcatcttcgtccataaatcttagcgccagcccgcagccgctgctgatggcgcccggaataggcatgatggccgcttttatccgttcctttgcatgcttttccgcctgtatggcatcggtcgtggtatcgaatgccatgatataataataatctggtctttccatatcataaatctctctttctgctatgcttgaacttaagatttattatatcatagatgccgggacagcgtaatagcagaagcagatggaaggctatgtctggacaaggcggatcaggcatgctattatcgaaaaagacggtgttatgattcatatttaccagaaagataaggagtaagatatgacgaaagaacaattagcaatagaagtgatagagcgtctgaaaaaggaatatccggatgccggatgtaccctggactatgaccaggcatggaaacttctggtcagcgtccgtctggcggcccagtgtacggatgccagggtaaatgtcgtggtggaagatctgtatgccagatacccggatgtggaggcgctggccgcggcagacgtagaagatattgaaaggatagtaaggccctgcgggcttggaaagagcaaggccagggatatcagcgcctgtatgaagatattaaaagaagagtatgacggcaagattccgagagattttaacgcgctgctaaaacttccgggagtcggaagaaaaagcgctaacttgatcatgggggatgtctttggcgagcctgccatcgtgacggatacccactgcatccgcctgaccaaccgtatcggccttgtggatggaatcaaggatccaaagaaagtggaaatggcactgtggaagatcattccaccggaggaagggagcgatttctgccaccggctggtatatcacggaagagatatctgcacggccaggacaaagccattctgtgatagatgctgcctggaggatatctgtgcgaaagccggggttgaaagttcaatataatggatataatcataagacaggagtagcatcgtattcatgatgttactctttttagcaagaacctgagaatggagggacaaagacatgtgcggcagatattatataggagactatgtttctgaaaaactagaagacattacatccggaaggggaatcagccagatcaagactggggatgtatatccttcccaggaggccgccgtattagtaagaggcgaagatggagcgcagacgagaatgatgtgctggggatttccgcagagccgtggcaagggacttttgattaatgccagggcggagacggcaatggaacgtcccctgtttcgggacagcatccgcaatcggcgctgcgtggttccggccagccatttttatgaatgggatcagtccaagaataaggtgaccttttgcagagaggattcgccggtactgtatatgacaggcttctatcagctttttgaggacaaggagcattttattatcgtgactacgaaagccaatgattccgtgtccggcgttcacgacaggatgccgctgatactggagcaggaggaactagaaaactggctgcatgacgatgactgcctggaattcctgcttggcaggatcccggcagcgcttaagaaggagcaggaatatgagcagcaggcgctgccatttatataggagggatcagttatggcgaggatactggtagatgcggatgcctgcccggtggtggcgggagttgaggaaatggcagaaaaatacgatcttccctgtaaattattctgtgatacgaatcatgtgctgaagtcctcctacagccagatagaagtcgtaggagcaggggcggatgcagtggacttcgccctgatcagccagttaaaggagggcgatgtcgtggtgacccaggattatggagtggcggccatggcgctgggaaagggcgcatatggaatccatcagagtggaaaatggtacacagacgagaatatcgatctgcttctgatggagcgtcatatggctaagaaagcacgtagggaaaagagcaggcatcatctgaaggggccggcgaaaagaaccaaagaagatgatgaaagattcaagatttccttagaaaaacttattttgcaaaagatcttttgcaaagattccaaagataattgctagccaaaaatacaggcatatattacaatatgagcaaagtttgtaagtaatggggtatacatatgcttgaagaaaaattaataaaactaagaaagaaacaaggctacagccagcaggaagtagcggacttgctgtccgtgaccagacagaccatatccaactgggaatgcggccaggcaacgccggctcttgataaggcggcagaactggcaagactctaccatgtcagtatggatgatctggtgggaaatgacgtggagatcgtattgaaagaagagaaagatgagagtactaataggagaaaagaccatcatctgctccagatgctgataggcaagcggtgcgttatagactgcgatgatatgtctctggtgctggatctggaagggtataccaagccaagagtcctcgatgtgaacgaggaatggatccgcgttgagtatgagcggagaaaagaaaataccttaaggcagagggaaacggtggtcaaactgattgaaatgtcggcagtcaagggatttcagatcatggaggacgagtagatggtaggatttatcgcttgcgtggcgctcgtgtttagcatattgtgcttctatgaaatacacacgctaaaaaaagataaggctaaggaggacgggggcaagtcccgggaaacttttgcggaacttttaagggggcttcatggcagggagtgcgagtttgtcgtagatggggccttgctatatctggatattgcatacagtgtaagaggcattgtggcagattctgatgatgactgggtgctgatcacttctaagaaggggaagaaggtgctgcagaggatgttccggatatccttgatcaaggatgtaaaagagattattcagtaaaaaagcagtttaaaacagttgcattgtgcagctgttttctttttttaataaaactatgttgacagacgacatatgtcgtggtacgatatagaaaaataagtcgtcagacgacatagcgtctggcgatatatgaggaggaattagatatgagaaaagaattatatataggtatcctgttgttttccctgacactttgcgcaaaatccgtagggccgatcccggaattcgcctcaggagcgctgctggggctttctatctgcctggaattcatcgggatactgccccaagaaaaatatatgaagttaaagaactttaagaaaaggagtctggacagatgggtaagaaagtagagcctttaacggaaagttatttctacattctgctttgcctggcaaatggaccgaatcatggatatggaatcatgcagcggacaaaagaattgtctgcaggggaagtaaagatcggatcaggcacgatgtatggggcaaccggaaatatgacaaagaagggctggatcgtagaaagcaagggcagcacagaggattctgaccggcgcaggatgtatgaactgacggaagaaggaagagagatcctggatatggagattaggagattaagacggctgctggcaggcgcagaagaagttttggaggaaaagtgatatgggcaagcggaaaataagccatgctgcatatgctgcatgggattacaagaaagagattgaagacttgaacaagaagtcgcaggaaggctggcagctggtaaagggaggatgcttcaaaagcatatatgagcagaatgatcaagcatgctaccgctatcagctggattataataccgatatagagaataaggtgctttacttggagatgtttgaggatcagggatgggagtatattaattctacttttaatggctggcattttttccggaagccttatgatccggaattaccggaagaagagtatgagatttacacggactcttcggcaattccggatatggagcgcaggtgggtacggctcgcctatagttttatggccgtgatttctgcttttctggttttcatgataataagaatgatacagtatccggaatggaccagaattccaatgatactttttgaaatcgactttattgtgtttctcggattgggaatctaccgcatccggaaaaaggagcggcatgtgaagaagatattttctctatctacgatgatggctatagcagtcgtatgctggcttgcggggattgtattgggagccttaaagcctgattgcagcaatacattggaaggagataccaatggggggacttattataaggattttaccgtgcattatccagataatttttatctggatcttgagatggataatgacagtccagtgacgtttcgtattgacgatgcaagcggtaaagccgtatatactaacagcgataagaaaataagaatagaaaacaggcgtatctggctgaaaagaggagattataggatcgccattgccagtgaaacgggcgaaaaagccagtaaaatgaagattttctacgaacttgactaaaatgatgatagaggagtgtggcgtacggcattaaaaaatggtgccgcgcgccttttttatattgacaaaaacaactgtaacaagtataattacatatacaacaactggaacaaaagtaattacagataagaggaggcaactatgagaactaagaaagcgaagtctattagtgttttaatacttagccttgtccttgtgcttacggcatgcgggtcaaagccagcgggaagcagcacggaaaacaaggcggaagagacaacagaagatgatagcggtagccaggcgtcaaaaacagtttttggcacgttcgaatccaagactcttgacggagaagatgtatctcaggacatattctccaaggcagatcttaccatggtgaacatctggggaaccttctgcggaccgtgcatcaaagagatgccggaactgggagagttgagccgccagtatgcggacaagggcgttcagatcgtggggcttataagcgatgtatccgatccgggagatgagacggcagaagatattatttctactgcaaaggcggattatacgcatatagtagcctctaatgatcttcagaatggaatcttaaaagaagtatatgctgttcctaccacatatttcgtagataaagacggaaaccaggtaggcaaggcttatccgggcgcaagggatatggatagctgggccaagattattgatgagatgcttgccgaggtacagtcatgagcaggcgcaagataatcggaatccgcattgcgctatttgccgctgcggcagcattcctcttcgtaggcgctgctcgcggcgaagcgggtactgtgtttacgaaagccgtaaatatttgtctggagtgtgtaggaattggctaagatgataaaagcaataaagaaccgtatgaggctgtgggtacagatcgtctttacagccgtaacaaatggatatctgcttggttttcttacaggccggatatatactggcccaactaaggcggcctgcgtacctggcctgaactgctattcctgcccgggagcgcttggatcatgccccataggctctcttcaggcagtgctgggaagccgggattataaattttccttttatgtagtaggatttcttctgttttttggctccatatttggaaggtttgtctgcggatggctgtgtccctttgggctggtgcaggatttgctgtataagataccattatttaaaaagaggaagaatcttccgggccataaggtgctgatttgggcaaaatatgttatacttgtattattcgtaatcctgctgccgcttctggtggtagatttcactggccagggagacccctggttctgcaagtatatttgtcccagcggtacgcttgcagcaggaattcccctggttcttctcaatgagaatctgaaacttgcggtaggaaatctgtttttttggaaggtagcaatcctgatcgtactgatcatactggctctatgggtttaccggcccttctgcaagtatctgtgtcctttgggcgctatctacagtttctttaatccggtggcgctgtacagatatcagatcgatgagagcgcatgtaccaaatgtggaaaatgcaagaaggcctgcaagatggatatcaaggtatgggagaagccgaacagcctggaatgtattcgctgcggagactgcgtgaaggcgtgtcctacgcaggcaatcagcagaagaaaaggaggttgccatgaaaaaaatcgtgaagcgggttagttttgccctggcaggcgcagcattaggatttgcgtactattcatttatcagctgcagcagcgggggatgagcgatcacatccagtccggtatggacggtggctgtaggaacaatattgggcctgctcgtgtcctattgctttgaagacagtaaggatacgaaggaataaaaaggttacggacgaatagaaaaggaatgagagagatgacgagtgaatttgcaattgcagtgcatgcgctggtgtatctgcatcataagaatgccgtgctctccagcgaagagttggcggaaaacatctgtaccaattcggcacgggtaagaaaggtcatggcgaagcttaagaaaaaggatttgataggtacaaaagaaggcataaagggaggctatcatatgtccctggatgcctccgagattactcttggggatatctgtgaagcgctgcaggtggatattgtaaaggccgcgtggcgatcgggaagtatggacatggactgcatgatcgcatccggaatggcgggggtcatggatgggatttatgcggaactggacgaaatatgcaagaagcgcctggaagggattacgatccaggatgtggaaaagaaagtagccggatgcaagaagtaagaaggcagctggattattttgatatttcgcagatctgcgactcgggccaatgcttccgcatgtcgcggctggaagatgacagttacgccataatcgcaaaagacagatatctgagacttgtacagaacgataaagagtgcttgttttactgcggcgaggaagaatttgatactttttggaagcagtattttgacctggatacggattatagtgcctttatagggcagatcagtccaagggacaaatacttgagccaggcggcagcagaaggaagcggaatccgtattctgcgccaggatctgtgggagatgatcgtatcatttctgatctctcagcagaatcatattgtccgcattcgcagatgcatagagaacctatgcataaaatatggggaagaacagcagaacttcgatggcagccggtattatacattcccggcgccggaagcgctagcctttctcgacgaagaggcgcttaaggaatgcaacctgggctatcgtagcaaatatgtggtgcgaacggcgaaaagtattgcagaagggcaggtctccttagaagatataaagagcctgccttacaggaaggccagaggcgaactcctaaaattatatggcattggagaaaaggtggcagactgtatctgcctcttcgctctgcataatctggaagcatttcctgtggatactcatatccgccaggcgctggaggcacattatccaaaaggatttccaaaacgccgttataaaggatttcaaggtatcatgcagcaatacatattttatcatgagttaatgggcaatcgctgatcagcgattgcccaatgtttttaagcagtctacaagttccaggtcgtcgctgttcaatttgatattagagcagtaattctttccatccggcgcggtgacggttatctcgatgatggatccttccacaagcgcctcctgggaaacggcctttaaaaacaggggaaacttcggatggcctgcgcgaaaacgatccaggcatcccttaagtttctgaagcatcgcgatctggttaaaatccatattcattgttctatcaactcctttgactatttctctatgaggcattatacttgagttagtaaaaatagtcaaaggaggtactatttatggacggaatgatgattccttcttttgatggaacaaaactgttcctgaagaaagaggtggcggcagatgccagtgctgtatgcgtgatcgtgcatgggctttgcgagcatcaaggaagatatgattatctggcggatatgtttcatggggcaggaatcgggacataccgctttgaccacagaggacatggaaggtcagaaggagaggagtcctattatggcgattacaatgagatgctggatgatgtaaacgtaatcgtggatatggcaattgaagagaatccaggaattccagtattccttctgggtcacagcatgggaggatttgccgtatctttgtatggcgcaaaatatccggataaagcgttaaaaggcattgtaaccagcggagcgctgacattcgataacggaggactgatcacaggggtgcccaagggacttgacccacatcagaaactgccgaatgaactgggcggaggcgtgtgctcagttgcggaaatcgtggactggtatggcaaagatccatacaataagaagacctttactaccggactgtgttatgcgatctgcgatggactggagtggttccaggaggcaggcaaggaatttgcctatcctgtactgatgatgcacggggaggcagatggcctggtggcggttcaggacacttacgatttctttcagatggcaacctccaaagaccgccagatgaagatatatggcggcctgttccatgagatctttaatgagtattgcagggacgaagttatcagggatgctatcagctggattagaaaccgtatatgagtatagaaagcataacgattgtataagcgagagattcccggggagagtcgcatctttccgggagttttattgacgttccagatattttatgttaagttaataatcaacaattcatccggcattccgccgatgagtagttttcatatcttttatgttcttgcggattccgcattaaatttcagacacaattttgcaaatgaatcaaaagaaaagtggtgatgcatctatgaagagcctatgatgtttttgttaatgagataaaacctgccggcgtgcggcaaaatgtcggtagactagccatcagcgggtatcagacatggataccccagggctatattttactaggaaattatgctaagataaaggagaagattttatgaaaaacagaatcattggttcggtagttcaaaaagccagaaattatcgagtgaaccggaaatataaggatcgactgttccgtcttgtatttcaggataaagaggacttgctgtcgctttataatgcagtcaatggcacggcgcatacgaatgcggaagatttgactattaaaacgctggaggatgcggtttatttgggatttaagaatgacctgtcatttctgatcagcaatacgctgaatctttatgaacaccaaagcagcattaatcccaatatgcctttgaggggattgatttattttacggaaatgctgaaggcttatgtggaagagcagggatataatatctatggaacaaaacgagtactcttgccaacgccgaagtacatcgtattctataatggattacaggagcagcctgatcgaatggaacttcacctttcagaggcctttctggaaaataagggaaaagatgagccctccttggaatgcagagcgattatgttgaatattaatcaggggcataaccaggaattgatggaaaaatgccaaagactggagggttactcctatttcgtggcggcggtctttacatatatgagccggggatatgaactggaagatgccattaatcttgcgattgatgagtgtgtcaaaaaagggaagattgccgatattctggccaaaaacagagcggaggtaaagaatatgctgttaacagattttgatgagaagaaatataggaagatgctgcgcgaggaagcgcggcaagaggggtgggaacaaggaaaagaagaagggagaaaagaagggagaaaagaaggaagagaagaaggaagagaagaaggaaaagaagaaggaatagaggcggcgacaaaaaggattaaccgattgaataaatgcctgattcaggacgaaagatttgacgatttaaggcggtcagcggaagatgttgattaccagaagagattaatcgaggaatataacattgagtaaaaaaactgcggaaaagtttctgaaacaatattttggctatgatggattccgggaagggcaggaacagttgatcgaggctgtcctttccggcaaggatgttctgggtattatgcctaccggcgccggaaaatctatgtgcttccagataccggcgctgatgatggaaggaattaccttggtgatttctccattgatctctttgatgaaggatcaggttggagccctaaatcaggcgggtatccatgctgcttttttaaatagttctcttagcgtggggcagtatgcaaaggccttggcgtacgccagggaagggcggtacaagattatctatgtggcgccggagagactggagacgcaagggtttctggattttgcgatgtcggaaggcattaagatttcttttcttgcggtggatgaggctcactgcgtctcccaatggggacaggatttcaggcctagttacctgaagattctggattttttaaagaaactgccttaccgtccggtgataggcgcgtatacggcaacggcaaccacggacgtgcgggatgatattatggacattctgcagttgcaggacccctttgtgattacgaccgggtttgacagagagaatctctactttgccgtcaggaagccggtagataagtataaagaactggtcggctatattcgaaggaaagaaaaagagatgcctggaagcagcggaatcgtctattgcctgaccaggaagaacgtggaggatgtctgttacaatttgagaaaagaaggattttcagttacgagatatcatgcgggcctaagcgatatggaacgcaaggaaaatcaggacgattttatttatgaccgccgacagatcatggtagcgaccaatgcgttcggaatggggattgacaagtcggatgtccgattcgtcgtccactataacatgccaaagaatatggagagttattatcaggaagccgggcgtgcggggagagatggagagccgtcagactgcattttgtattacgagcctatggatgtgcgtacgaaccgattctttatcgaaaataatgaggacaatgaagcgctggatgagataacgcgcagacttgtaaaagaacgggatgaagaacggcttcgccagatgacattctattgctttacgactggctgcctgcgcaattatattctggattattttggagaggcaagtcctggatattgtggaaactgctcaaattgcatgacccagtttgaggatgtggatattgccagagaggccgcggccattctcagatgcataaaggcaaatcatataaactatggagttacggttatcatagatatcgtgcggggagcaggcaatcagaagatactttcaagaggccttgacaggaatccggagtatggaagcctgaaggaagttacagtgccaaggcttcgccagataatccaggaattattgttccgggggtatttggaattatcaaatgacaattacccggtgctcaaagcagcagacgcagccgagcaattgcagcaggaacaagtgcttcttttcatgaaactggcgaaagaaagagagccggaaagatccgccgggagagggaaagtaagacgcaagaaggccggggcggctgcatccctggaggaaaaggatttggaacttttcgagactctgcgcgcattgcgaaaggagattgcggcggaggagaaggtacctccttacatggtgttttccgataaaacgctggcgcttatgagtgccgccaagccagagaattcgagcgagattcttatgatcagcggcgtgggcgaatataagatggagaagtatggggcgagatttttagaagcaatagcccggaggatataagtgatggatttacaatatgcaagagaagcgtttgaacgctatctggaacaatatgaccaaagtgatgataaagtaaggctcaagatcgtacatacttatggcgtggcagaggccagccgccagattacggagcggatgggacttagcccggaggatatagacttagcccagctgatcggcctgcttcatgatatcggcagattcgagcagataaaaagatttgacagtttcgagcccagtactatgaaccatgcgaagtttggcgttcgaatcctgtttgaagaagggctgatccggaggtttataagagaagacaggtgggatgacattatacgaactgcgattataaaacacagtgattttaaactggaaggaatcgaggacagccgtaagctgttacacgcaagaattatccgggacgcggacaagctggataactgccgtgtaaaattggaggatgcaatagagaccatgctgcaggtgaccgccgatgaggtaggaaatagcaagatcagccccgaggttatggagcagtttcggaggaaagagtccatacgctcactgacgagaaagacgaagatggattattgggtatcctatctggcatatttttttgacattaactatcaggtttcttttgatataattgaggaaaacaattatatagagcgattgattgcaaggattccttattcgaatctggagactgctgagcagatgttggagataaaagaaggattaaagcaatatgtaagcgctgccagatgcagcaaatatttcaactaaggtaaataggcctcttatctggcagattcaagaaaccgccatgctttttcgtttagaaaaaggcatggcggttttggctatgagattatggccttatgcaaccatctgctgtcctaaaaggtcggctgccagcaatgcatcgtaaagttgctcaggagttacatcacctggcatgttatgaatcgtttctccgggagcgcatgctttgcgcgcagcaatcagcacccttgcgttatccgaaacgccaacctctttaagcgtaataggaaggcctacgcttttacagaatttcattacggtgtccaattcatctttaggggccccttccaggattaattgggcgatggttccaaaggcaaccagactgccatgcatcgttttttcacattcttcaagggcagtgaacccgttgtagacagagtgcgcaactgcaagtccgccgttatctgcgcctacgccgcttaagtatgtattagcttctatgatggcttctaaggcaggcgttaccagattctgctcgcatgcggctttcgcttgaacgccatattccagaagggtttcatagcatagtctgcaaagggccatggcagagcgggtaatgccgccattttcaaggctgggagcatccattttctgacatacccgcgcttcaaaataagtgcctagggcatctcccattccggctaccaggaatttggccggggatgcggcaagtactgcggtgtcaacaaggacggcctccggatttctgggatagaagagatagctgtcaaaggtgccgtcatccttataaataacggaaaggccggtacatggagcatccgtggcgcagacagttgggacgattacgacaggcagatgttcgtagtaagcagttgccttagcagtatctatggcagaaccgcctccaattcctactacgacttgtatgttcttttcctgtacgatcttgcgcattttttcaatttcccctacagaactgatgcctccaaagatttcgtactgcctgtagcagtcggaatcagcaaaactgttctcgatcttggcatgacaagccttgtgtccgctgcgggagcagacgaataaatagttctttcctaattcgctggtatctccgtagaaatggagcaggcagtcttttccctgcacgtatttcaaaggagcacgcattaattttgttctacccatagtaagacctcctaaaatattaagtatgacttaacattacaatattgttatttttttgtcaatataaaattggaaaatagacagagaaaatgttaaactatatatacttagtcatgcatagcgcgcctgtcacgatgaagtatgcaatccggggcaggcatgggcatcatgaaaagggaggaaaatcattatggcagaagatatagccttgcccggagaaaagttgaaaacatttcggaaagaagcaggactcacattaaaagcagtagcagatgaattaaaagtatcgattccatttctcagcatggtggagaatggaaagagcggaatcagttttgaaaatctacacaggatgcttagattatatggaaagaatctgggagacttgaccgagcaggaggaaaaagcaaggggagtcattaatatgcaggaatccaaaaggatagcagcagaacctggaatcgatatctatgggctcgcaagtatcaatgaccctatgcagggctatatggcgggcttcatcctggatatcgctccaggggcttcgaatgactatgactcgcatacgggactggagtacgtatttgtattaaaaggctgcattcgcctgacgctgaatgggcctgatggcacgcggtcaatagagatgcaggcgggagattccaagggccaccttgcaggagacaggcatatttatgaaaatataggaggagagcaggcacagatcctggtggtggaaagtacgcctggtggagatcacgaaagtctaagacatttttaagaaagtgtttatagaattccaagatttcccggcgtataataactaccatacacatgaggaggtttttggtatgtggcggaagtcaagaaatgcagtacaggcagaggaagaagtatacgatcatgaatatgagacgcccaggaggcagactacccgttatcagccggattacagagagggtcttaccagccagcaggtgagggagcatacgcaggatggatggacgaatgtggcggtagatcctccagcccagacgaccagggagatcattcatgaaaatgtatttacttatttcaacctgatttttacagtgctggcagtacttctgtgtctggtggggtcatttaggaaccttacttttctgccggttatcattatcaatacgctgatcgggatcattcaggagattcgggctaaaaatactttggagaagctgagcatgctgaatgcgccccacgccaatgtcgtgcgggatggcaagacgttaaacgtggattcggaggaactggttttggatgatatcgtcctgtttaaagcggggaatcagatctgtgcggatgccatcgtagtagacggtgaggtccaggtcaatgaatccctgctaaccggagagtcggacgagattactaagaagccgggcgatcatctgatgtccggcagtttcgtagttgcaggccagtgcttctccaggctggaagccgtgggagaggattcctatatttccaaactgacgctggaagccaaggcaatgcagaaaggcgagcagtcagagatgatccgttcgctggacaagctggtcaagttcgttggcattgctctaatcccgatcggaatcgtgcttttcgtgcaaggattcttttttaatggcgaaggattccgcaatagcgtcacatccatggttgcggcagtcatcggcatgattccagagggactctatctgctggctagcgtagccctggcagtaagcgcaatgcggcttgcgcataaaaaggtgctcctccatgatatgaagagtattgagacccttgccagggtggatgtactgtgcgtagacaagacgggcaccatcacagagaattctatgagcgtaaacaaactggtgcctacagaagaatatgacaaggaaaatatgccggaactatccaaactggtaggcgactttgtaaaggccatgagcagcgacaacagcaccatggaggctatgaaggaatatttcaaggaaggcactggcgcagcgccggtcaaggtgacgccatttacatccgctacgaagtatagcggggttgcctttgaagagaaggcatacgttcttggcgcgccggagttcgtactgcgggaggattatgatacctatcgtacggagattcttacctatgccaagagaggctaccgggtgctggtatttggcagttatgccggcgctttggatggaaagaaattgacagagaaggttacgcctcttggctatgtgcttctttccaatccaatccgcaaggaggccccggagaccttccagtattttgccgagcaaggcgtggaggtaaaggttatttccggtgacaacccgctaaccgtatctgaagtggccaaagacgcggggatcaagaatgcagaagagtatgtggatgcggcgactcttgagacggaagaggatgtaaagaatgcgatcgcaaaatatacggtgttcggccgtgtcaccccgggacagaagcggcagttcgtgcaggctttaaaagagcagggaaagacggttgccatgaccggagacggggtgaacgacgtattagccctgaaggatgcggactgcagcgtggccatggcatcgggaagcgatgcggccgtccaggcgtcccaggtagtgcttctggagtcggattttgcatgcatgccatccgtggtgctggagggaagaagggtagtcaacaatatccaacgttctgccagcctgttcctggtgaagaatattttttccttcctgctgtccttgttctcggtggcctttatgatcacttatccgctggagccttcgcagatatcgctgatcagcatgtttacgatcggcataccggcgttcttcctggcgctgcagccgaataaggaagtcatcaaagggcattttcttaccaatgtatttttaaaagcgctgcctgcagggctaacggatgtactggcggttggggcgctggtcgtattcggacagaccttcggggtgggcgccaaggacatttccacggcagctaccatgcttcttgccatcgtgggattcatgattttgtacaaaatatgccaaccgctgaatacaatccgtgttatagtatgggtaggctctatcattggccttctggcatgcagtatatttctaccggatttgtttgcgattacagggatgtccagcaagtgcatcatgctgttcattgtattctcgatcgcaacggaaccggttctcagatatctgacgctgctggttggcggcttgaaaggtttatataagaagttctttcacaaagcgtgatagaaggcgggtatgtcgcaaggaggatgaatatgaaaatagtaagtctgatggaggatacgccaggtgggaatggctgtctcttcgagcacggcttcagtctctacgtggagaccaaaagccatagaattctggcggatacaggagcgtcttgcagattcctcgagaatgccaagcgtcttgggattgaccttgccaaggtggatacggttattttaagccatgggcattatgaccatagcggcggcattctggcgtttgccggaaagaatcccaatgcccgcatttatattcgggaaaatgcattcgaggatttctaccacgtcaaagatcatgggcgcaggtacatcggaattgataaagaaattaagaaactggagcaagtggtgatcgcagggagcgatctcaggatagatgaagagttattcctttttacgaatgttacaggaagaagaatgtggcctgagggcaaccgggaattaaaagtggtgaaaaatggagaactgcttcaggatgactttagtcatgagcagtacctgattatccaaagcgaagggaaggagatcctgatatccggatgcgcccacaatggtatcctgaatatcctggagcgatactggaatataagaggccgtatgccggatgcgctcattagcggattccatatggcaaaaaagtcagcgtataccatggaggaagaggaacttatccgcaagacggccttagaacttaaggcttacccaatccaatactataccggccactgtactggagaagcggcatatcagttaatgcaagggattctgggaagccagatagaatatataagatgtggcgggagcatagagttatgatgaacgcagtggaattaacccgggaactgatagcggttgaaagcacaaatccaggtatgggcgaaagtgatatggaacggttcatactaagatatctgcatggaacaggagccgcgctggcctccgaagaagtatttccagggcgcaataatgtgatggcaactttgacaggagaagaagttgccccttcgctggtattcgtctgccacatggacaccgtagtggaaggcccgggctggacgcgcgatccatttggggcagaagaagaggatggaaggatctacgggcgcggagcatgtgatatgaaagcaggacttgcctgtgcccttgtggtctttcgggaaatagcggaaaatgtgaagcatgggaagatgaggcttaaatatccgctcaagcttctgtgcacggttgacgaagaaggaactatgcggggcgctgagagggcagtcctatccggccgggtgtcaaaagatgactgggttctggacatggagcctaccgggggacagattcagatggctcacaaagggaggctgtggcttcaagtggatgcccagggcgtgacggcccatgcgagcaggacggaagacggcgcggatgcaatcgcggccatgggagaattgatcagttgcgtaagaggggaatttgcccggatgccggagcataaagaactgggcaggccaaccgtgacttttggacagattgcaggcggttaccagccctacgtggttccggacagatgcaggctgtggatggatcttaggctagtgcctcctcttgacgataagaaggcgctgctgatcgtagaagaaggattgaagaaggcagaggaagcagtgccaggagtagaattccaatataaaataacaggaaaccggccatgtatagagaaaaatgatgcgtcttcattgctggcaggattaaggaaagcatgcaaaaagtctcttggagaggaacctgaggtaggtccatttcctggctatacggatacggcggtcattgccggaatgctgggaaacggtaattgcatgtcttatgggccgggggatttgaagatggcccacaaaccagatgagtatgtaaagattgaagatatagaccggtgtgttctggtattaatgtcattggtagaggagatgaacagcctatgaaatttaaagtcatattaggggatattacgaaagttacctgtgatgccattgcaaatgcggcgaatactacattgcttggcgggggaggcgtagacggagccatccaccgggcggcaggaccggaacttctgagcgagtgcaggacgcttggcggctgccggacgggagaggcaaagattaccaacggttacaggctgccggtaaaatatgtgattcatacgccaggtccagtatggagaggcggaagccatcaggaagagcagctgcttaagaattgctatgaaaactgcctgaagcttgcggcagagcatgggtgcaagagtatcgcgttcccatccatcagtaccggaatctacgggttcccgctggaaaaggcagcgcctatcgctgtccataccattcgttctttcttaaaggagcatccggagatagaaaaagtccagatggtatgttttgatgagattacaaaaaaatattatgaaaacgcgctagatggataagaggtttccatccagatctttccacaggaatcctccgtcaaaggtcatatagccgcagacagagttttcttttggaatggagacagagccgggattcatataagtataagttcccatattccgattggccggtacgtgggtatggccattgagcagaatgtctccttccttcagcatcggaggactttggggattaaagtggtggccgtgggacgcaaaaatgctgcatccgttaagttccagaaagcaatagtctgcaaggataggaaactccaggaccatctggtcaacttccgtatcgcagtttcctctgacgcataggatttcctgcttcttgggattcaaaaggctgatcacttccttgggattatattcctttggcaaatcgttcctggggccatggtagaggatgtcgccgagcagaagcagacggtcagcctgctcgcgttcataggcttttagcattttccggcaataataggcagaaccgtgaatatcagatgcaatcattaatttcatttatatatacctcgctttatacggattatgaaggaattgtagcataaaattggtgcagagtaaaattcatttttcatacgttcagggttatgttatactggtaacggaggtgaactatgctgatttcccttaccataatagcaatcgtgatcgtggcatgcgtgctatgtaacaagttgacgaataagattggtgttccaatgctgctggcattcatcctgctgggagtgatatttggttcggatggaatttttaagataccgtttgacgactttgagttcgtggagcaggtatgtacagttgccttgatatttatcatgttttatggcggattcggaacgaattggaaggaagcaaagcctgtcgcgccgaaagcgcttcttctatcatcggtgggagtaattgctacctctttcctggtagggatcttctgttactatattcttcattttgaatggctggaaagccttctgataggtgcggttctgggctcgacggatgccgcatccgtattctcggtactgcgttccaaacaattaaatctaagatataagactgcttctttgctggaactggagagtggcagcaatgacccatgggcatacatgatgaccgtgattattctttctatcatgcggggagaaaacagcacgccccttcagatcgccggaacagtattctggcaggtactggtagcggcggcagccggcgcagcaatcgcggggataagcgtatgggcgatcaggcatattgagtttgaaacatccggttttgggacgatattcgtggttgccatcgcattaatggcatatacatttccatcgcttctgggaggaaatggctatcttagcacgtatatcgtaggaattgtccttggaaactgtacgctgcctgttaagaaagagatggttcattttttcgatggtgctacaggattgatgcagatgctggtattctttttgatgggactgctttcctttccttcccaaatggcaggcatcctgctgccagcgatagcgatatttctgtttcttacatttatcgccaggcctgtcgcagtctgccctatattgactgccttcaaatccagtaagtcccagcaggcggttgtatccctggcagggctcagaggagcggcatccatcgtatttgccataattgtgacggtagatgatgcgtatacaaagaatgacatcttccatattgtgttctgcgtagtccttttgtccattggccttcagggaacgctgcttccgatcctatccaagaagctggatatgattgacaatagccaggatgtaatgaaaacatttaatgattatgcgcaggaatcgtctctgcagttcgtaaccttgacgctgatggagggtcatgcatgggtaggaagagaaatccaggaactcctgatgccgccccagatgcgtatcgccttgataaggcgaggggatagtcaggtgattccgaaaggaagtacgatattggaaagtgcggatgaattgattttaagcgctatagaatatcaggggataaggccgattggcatgaaggaaacctatattgacaaaaagcatcgatggaatggccgaaggctgtatgaactggcatttccacatgccactgtcgccatcataaaacgtggcggccaggcatttgtaccggtgggagataccaggatactggagggagatatgcttctaaccattgaagatacaccgcgaaaggagaggggaagatgaaccagaagatcgaaatctgctatgcaaaagaagaagatgtcccggatattatgtctgtaatggatatctcctgtcaattagccagggatgcgtcctggtattgcgcggatgatgaaaactatgtcagaaagcatcttcatgaaaacggatttatattaaaggcagaggcagagggccgcctggctggattccttatcgtccgctttcccaaaaacgcaaatgataacttgggcagttacgtacgcctaacaaaagaggagatgcagtatgtggcacatatggaatccgcggcagtaagcccggactaccggggatataaactgcagagatgcctgatggacgaaggagaaaagattcttaaggatacgcagtacaagtatctaatgggaaccgcgcacccggaaaatatttatagcgtgaataattttctccagctggactatgagatagtagccgaagataataagtacggcggcttgcccagatatgtgttctacaaaaagatcgaaaaataagaaaagcgctgttactcaaggtacagcgcttttaatgtatcagccatagattcggaaagtccgatcttatcttttagaaattgccggatgctgccggaagtttcttccatgatctgaaagactctcttgatgtaattttccttgacgcccatacagattcgaagactttcaatctggccggggtcggtaatcgctgcggacagtcttttaagtatcagttctacctcatcttttagaaaggcagcggtcatcatataatcttcaataatggtatccatatctacatccaaggtatacaaaagcatggcagtccccatgcccacccggtcttttccggcgctgcagtgccacagcgtggctccttcttcctgcctggccagaatacggaagaactgagcatactgcttcagggaataatcgctggtgatgatatcttcatataatttctgcatatagaatgtcgggtctacgccatgctccttcatagccagcgtggcttcctccaaagtcattttttcggaggtctcatcgtgggttatgccggcagccatagtctgaagaatgggattgctgatgtgggtagcgccttctatatgaggatctggcttctcagcctgttcatccaaagtccgaaagtctacgatggattttaagccatattcatcggagagcacctttttgtcgttctccgtcatgtggtagagctggccgctgcggatcagccgccgtggacggacgcggtatccgtccagggtctctatgcctcccaggtccctggtattaaaaaggccctcaagtgggattcgttgtataggattcataataaacctgcctttccaaataatatttctaattattacgttacttttcattatagcatatttcatgctataatgaacaaatgaaaatcctgggaggcgaaagagaagaagttatggggaaatatattcgtaaaatcatggttgcgctgctgtatgtagccacctttggcctaagcgtggcaatctttgtcagcaattatctgtgcaaattcatgctgggaacaagaaagcatttgaaaaaggcgaaagaaaaggatctcctgacccagaaacaggaacagaaccggctctttatgagcgccaacggaaaagacgtgtacataaccagctgggatggcctggaacttcacggtctggagattccggcaaaggaagagagccataagtatgtcattatctgccatggctacaagagcaatgcgcttaatatgggaggcgacgcgatccgattccgggaggcgggctaccatatcctggcgccggatgccagggggctgggcgagagcgaaggaaactatatcggaatgggctggcccgaacgccgggacgtagtggactgggcaagacggattattcaggaagatggacaggcgaggattctgctatacggcctttccatgggggcggcaactgtcatgatggcagctggagaggaagaccttccgactcaggtcaaggcagtcgtagaagactgtggctatacttccgtatgggaagaattccaggtgcagatccgtaagatgtgccatcttccggcatttccattcctctatatagcatcggcgatcatgaagagaagggccggctatgattttaaggaggccagcgcccttgcgcaggtggcaagatcacagattccgatcctgttcattcacggaagcgaggatctgtttgttccatatgagatgcacgggcgactatttgaggctgcaaggtgcgagaaggaaaggtttgtcgttggcggcgccgcccatggggaagccagtattatcgacgaagacagatattgggagcgcgtgataagttttgcggacaaatatacgtcatagatgggagaatatgttatactggatatataaaaataattaagggggtattcttatgacagaagaattgattagagaagttaagcatatccaaaaatgccttgtaaacaaggaaatgacgggtgaggaatgggaagagaagatggcggctgtcaataagctggaagaagtatcggactatctgaaggatgcccttggacggggaattgagttttaaaaaggaatttgaacaggatgattgatggaagtgtaattgaaggaattgtatttgatatggatggactgctgtttgattcagagcgtatcgtgcagcggtcctgggaggatgccgggaacgagcttggcatccggcatatgggaagccatatctaccatacgctggggatgaatgtggtaggaaggaatgaatacttcctgcgggtaatcgggcctgattttcccaaggaagagtttgcagcgaggacgagagtccgattccgggagattgtagaggaagaaggccttccggttaagccgggcgtaatggaacttctggaatatgggaagagcagaggctataagatggctgtggctacgtcatccagaagcggctacgctatccataatctggaagaggcagggatatatgggtattttgacggggccatattcggagatatggtacaccgggcaaaacccgacccagagatatacttaaaggcatgcgaggccatcggggcaagaccagagcgctgtatcgcccttgaggatgctccggcgggaatccgctctgcgtatgcggccggcatgattcctgttatgattccggatctggtggagccggatgaagagatcaaagcgttggtccacaggcagtttaaaactttgcatgaggtgattggacttctggaacagatggacattggaaaatagaaggaatgacaggcattttgcctgtcattccttctattttataaatctggctttttattcttctacaataaatacttcttttcccattccgcagatcgggcatacccagtcgtccggaatatcttcgaatgcagtacccggggcgattccgccgtcaggatctccgatttcaggatcatatacatagccacatggttcgcataaatatttctgcatgacttcttacctccaattatttttagttatcgtcttttttccataatccgtgtagattacagtattcatatgccgcaacaaactcgtccccttcgggaagaatgaatacagccttgggatccatgcccggcgcaagccttctgtactgcgcgccaagccgagtctcgatatagatgcctgtaatgtaatgctcatccagcatagggtgagtcacggagccgactgatacctccactacgttatcttttatggtaacgacaggaacgtgtttttcctgtgcggcatctgttgtgttcgccttgatttcctcaagtgacggaacagaagcgctctcgctaagggagatcagttcctggaatatattatgtgagttctggtctttatagaatctgcccataaaaaagcctccttcatgttttccattagtttttgctgtttctgttaatagaatacatgaagaaggagtttatttctgtgacttggttacaaaactatacgtttttttaaaattttaacgggattcccatctgccggaggctccgcatggaagtaccagtttagagcgcgtcactggaagtccgatctcctgcgaatccacattcccatcaaatctctctagttccgtggccagcatgtaggtgagcacggctggggcaaggcctgtagtataggagttgaccagaaagaacagaggctggtcagacaggatctgcgtgcaaagcttgatcagagggtggatggcatcctcaatcttccagatctcgcctttgggtcctcttccgtaggaagggggatccatgatgatggcatcgtaatggttccctcttctgatttcccgctccacaaatttgacgcagtcatccaccagccaccggatcggcttgtcggacaggccggaagaagccgcattttccttggcccagcttaccatgcctttggatgcgtctacatgggtgacgctggcgccggcggccgcagcggccaatgtagcgcctccggtataagcaaagagatttaagacctttatcggacgtcccgcgtttcggatcttttctgaaaaccagtcccagtttgtagcctgttccgggaaaagtcctgtatgcttgaaactaaaaggcttcagattaaaagtcaagtctttataatgtatctgccattgttccgggaggcttatgaattcccattctccgccgccctttttgctgcggtgatagtgtccgttcttatgcttccagccacggtcgttcttaggagtgtcccagatgacctggggatccgggcgaaccaggatgtattccccccatcgctccagcttctctcctttgctgcaatctatcacttcataatctttccattgatctgcaatccacatgattatctatcctctcctgtttctgacattataatccacaatcacttaggattatagcatgaaggaatgaaaaagaaaagaagagggttttgggactttacatagatttaacattgggcggatttcagattttacattcatcctttatgatagcaaatgtgaagaagagattcgattgataaaggagagaaatgattatgagattgaaaaagtttatcgcagtattggcaattgttggaatggcagcaggactcgccgcgggatgcggaaaatcagatgctggcgatggaaatgataagaaggcagaggcatctgaatgggatgcttctatggatgtcactatcgtatccagagaagacggatcaggaacaagaggggcatttatcgaattgttcgggattgaagatgagatagacggcgagaaagtggatatgactacgcaggaggcccagattaccaatagtacttccgtaatgatgacaaccgtcgcgggagatgactatgcgatcggatatgtatcccttggctcgcttaatgatagcgtgaaggccgtgaagattgatggggcagaggcaaccgccgagaatattaagagcggtacgtataaagtgtccaggccattcaatatcgcaaccaaggaaggggccgataatgcggtggccaaggacttcatcaacttcatcctaagcgaggaaggacagaaagtagtggcggacaatggatacatttccttagatgaagcaaagccatacgaaggaagcgccccggagggaaaagcggttgttggaggctcgtcttcggttgcgcccgtgatggagaagctgatcgaggcgtataagacggtgaacgataaggcagaaatcgaacttcagtctaccgattctaccaccggcatgacatccgctatcgacggaagctatgacattggcatggcatccagagaattgaaggatacagagacgtccgaagggctggttccccaggtaattgcgacggatggaattgcggtcatcgtaaataagaacaacacgacagatgagttgagcagcgatcaggtgaaatccatttataccggagaagcgcttacatgggatgaggtagtaaaataaaatgaaatcaaaagcatggactgaaaaattcatgcggggagtgttcttcattgccgcctgtgcttcggtactggcggtagctctcatttgcatattcctttttgcgaatggcatccccgcaatgaaagaaattggatttggcaaatttctgaccggccagatgtggaggcccaagaaccagatatttggaatctttccaatgattataggaagcctgtatgtcacggcgggagccatactcttcggagtgccggtgggaatcctgacctccgtattcatggcgcattattgtccaaagaagatctacaggccgctgaaagcggcaacggaactgctggcaggcatcccatcggttgtatatgggttctttggactggtcgtgctggtgccatggatcagggagatgggacgggggcttggcttcggaggaaacggaagcagcatccttacggcatctcttctgcttggcatgatgatccttccgacgatcatcggcgtgacagagtcggcaatccgtgcggtgcctgcccagtactatgaaggagccgtggctttaggcgccacccacgagagggcgatcttccgggtgatcctgccggcggctaaatccggcgtagtagcagggatcgtgcttggcattggccgggcgatcggcgagacgatggcagtcattatggtggcgggaaaccaggccaggatgccggcaggaatcttccgcggcatccggaccctgacagccaatattgtgatagaaatgggatatgccacagacctgcacagggaagcgctgattgcaaccggcgttgttctctttgtgttcattttgctgatcaacttcagcgtagcacttctaaacaggaggggaagccatgagtagtagccaggaaagattcaagcagaggcttaagtcatacgcgaggacgccgggatcattcattgtaatgcttctggtcgtactgtctgcggttctgacttttaccgtactgatatttctgattgcctatattttgattcacggaattccgtacatcaagccatctttattttctctgacctatacgtcagaaaacgcgtcactgatgccggcgctgatcaataccattgccatgacgtttttatctctggtgattgcagtgccttttggcatattttctgctattttcctggtggaatatgccggacggggcaataaatttgttgaaatcatccgtctgactacagagaccttgtcaggcatcccgtccatcgtctatggattgttcggcatgctgttctttgtgactgcatgtggatggggattctcgctgctggctggcgcatttaccctgtctatcatgatcctgccgttaattatgcggacaacggaggaggcccttaagtcggtgccggattctttccgggagggaagttttggcctgggcgcaggaaaacttcggacggtgtttcgaattgttcttccatccgccgtgccaggcattctcgccgggataatcctggcggtaggaaggattgtgggtgagacggcagccttgatctacacggcgggaacggtggccgatgtgccaaacggcgttatgggatcgggccggactttggccgtgcatatgtataatctggcaagcgaaggactgtatatggatcaggcgtatgccacagcagtcatactgctgcttctggtcgtggggatcaacactctgtcaggcgctgtggccagaagattaacgaaagcgtagagaggaagaatcatgggaaaaattagtattaagaatctggatttatattatgacgacttcaaggcgttaaaagatgtgaatctggaaatagaaacgaataaaatcacagcgtttatcgggccttccggatgtggaaagtctacccttttaaagtccatcaaccgcatgaatgacctggtggaaggatgcaggatagaaggggatattcttttggacgggcaggatatatttaaggaaattgatgtaaacttgctaaggaagcgggtgggcatggtatttcagaagcccaatccatttccgatgagcatctatgacaatatcgcttatgggccaaggacccatggaatccgttccaagtcccgactggatgatattgtggagaaatccttaagagacgcggcaatctgggaagaatgcaaggaccggcttaagaaaagcgcccttggaatgtcaggaggacagcagcagaggctgtgcatcgccagggctctggccgtgcagccggaagtccttttgatggatgagcccacgtctgcgctggatcccatatctacatcgaagattgaagaccttgcgatggaattgaaaaaagattatactattgtaatggtaacgcataatatgcagcaggcggtccgcgtgtccgacaatacggctttctttttgcttggcgaggtcgttgagtacaatgatacggagaaacttttctccataccatcagataagcgtacagaagactatattacagggaggttcggttaggatgcggaataagtttgatatgcagttagagcgcctcaatgagcagctgactcatatgggaaaattgtgcgagattgccattaataaggcgactatggcgcttcaaaatggagacatggagcaggcaaaggcggttcgggaggcggatgatgagattgaccagatggaaaaggatattgaacgtctgtgcctgaaactgctgcttcagcagcagccggtggcaagagatctgcggcagatatccgcggcacttaagatgatcacggatatggagcgaatcggggaccaggcatctgatatcgctgagatcatcatctctgccaggatgacggaggcgatggacatctcgagaatcgggcagatgtcggaggcagcggcaaagatggtgcgtgacagcgtcacagcctatgtaaagaaggatctggaattatccagagaagtgatggcttccgatgacattgtggatgagatgtttgaagaaaataagagagaacttgtcagttttattgcagaaaaaaaaggtggatatggggagcgggcgatcgatctgatcatggttgccaaatatctggaaagaatcgctgatcatgccaccaatattgctgagtgggtggaattctccatcactggaatacacaagggaatggaaacaatgaagccaaaggagaattagcatgatattttgcgtggaagatgacagcaacatacgcgaactggtcgtatatacactggaaagcaccgggcttaaggctcggggatttgaagagggaagttcctttctggaagcgctggcgctggaaacgccggatcttgtcctgctcgacatcatgcttccgggagaagacggcatggaactgctgaaaaaactgaaggcctcgcctaagacgagggatattccggtcatcatggttaccgccaaaggcgcggaatatgataaggtcatgggacttgacaccggggcggacgactatgtgaccaagccattcggaatgatggaactggtatccagaatcaaggccgtcctaaggcgaagcgcccgagaaggaggccagaaggaagactctatcgtgattggcgagatagagatgaatctgaagaagcatgaggtcacggcagcaggggaagtcgtaagcctgacgcttaaggagtatgaacttctgaagcgtcttatgaagaattccaacattgtgctgaccagagaccagctgctggaagatatctggggctatgactttgacggagagaccagaaccgtggatgtgcatgtcaggactctgcgccagaagctagggagcgcgggggagcgcattgagacggtccgcggcgttggatatcggatgagcgaataacttgcgtgaagggacaggaatcagtaatgagaagaaagatacagcgaagcatgatactggtaatcaccaccaccttgctgattacctatgcgatcaccacctttgtggtgtatcgccagacgatcagccttatggaagatgagatccgccaggaggctgactatatctgcgcggccgttggaatctccggcgaggcatacctcaaggagatggacgcggtgcgaaagaacaccagggttactatgatagacgaccaaggcagggtgacctatgattccaaagaagacgaagtgaccttggaaaaccataaaagcaggccggaggtgaaagaagcgctcagtagtggaagcggccaggatatccgcaagtctgataccctgggccaggagatgttctattatgcccagaggcttcctgacggcaatgtcttaagggtctccaagacggttgatacggcattctttacggcaataagaatcctgccggcgatgggcgtgattgccgtggtgatgcttttgatcgcatggattctggcaagatggcaggtagcaagactgatccgtccgattaatgaactggatcttgataacccgatggaaaatgatgtgtatgaagaattgacgccgctgcttatgagtatagacagacagaacaaggaaaaagacgcgatcgcaaatatgagaaaggaattctcggccaacgtatctcacgaattaaagactccgctgacctccatatcaggctatgcggagattatgaaggacggcctggtaaagccggaggatatgaagaagttctccgagcgcatatataatgaagccagcaggctgattaccctggtagaggatatcatcaagctgtccaggctggatgaagggaaggtagagttggagaaagaggaagtggatctctatcagcttgcaagggaagtgtgcagccggctggcaccccaggcgaatgcaagagacatccgtatagaggttaccggggaagccgtgacttacaagggaatccgtcagatcttggatgagatggtatataatatctgcgagaatgcaatcaagtacaataaggaaggcggtgccttaagcgtctgggtaggcagcacgctgaaaggcaagaagattatcgtgacagacaccggcattgggattccagcggatcagcaggagagaatctttgagcggttctaccgggtggacaagagccactccaaagaaagcgggggaaccggccttggcctgtctatcgtaaagcacggggcgatgatccatgacgcggatatccgggtggaaagcgaattgggaaaaggcaccagaatggaacttacattctgatgcctgcaataaatgcaatggcttttatgatgtcctccttcaactgctgatcatccagctgtggatcgttgcatttctgctctagcttgtacttgcagtaactgacgatcaattcgttctgcatcgtcagcgtctctttggttataagattatcttcccggagcataggcataagaagcttaaggctccggtcattaatatttttcccaaaatacatggactcgatctcttcggagaactggtcccgttcttccgggaagatctcatagtaccggttcatgatctcaggaagattgtcactgcgttttccataaaagaaattgtagaatatatgaggcttcttaagcatggtatccacaaaaagttcccatatagacagaaaattttcagtaggagacaggttcttttggctttgtaactcaagggaatgactatattccctgaaatatttcagggaggcgaacatagccagctgatccaggtcttcaaaatagagataaatggtggagttatgaaatccagccttctgcgcgatcttgcggaccgatatattctcaaggccttcagattctatcatttcctgggcggcattaataaatgttctggcgttctgccttttttgctcttctttatctatcagttcagattctttcattgttcataaatcctctcttaatcacagtggtcttctgtgtaaatgtaccatattttgccttcaaaaaaaagcatagttcacaaaaaacttgcgaatgacaaataattgtcaggtttggattgacaataagcgcgcttattgctattatcattgtaagaaataataaataagcgcgcttattgaaataacaaatagggcaaattatacaaagagtgcacactttggatttgccggcaagaagatgaatgaaggaggattatcatgagactggagattggaaatttctatgtacaggatatcgcattcggagagaccctggcatattgcgacggagtcctgtcaattaataagcaggaggctttggactatatcaaagaagatgacaggatcaccgaggctgacctttacatagcaaagccgggagataagatccgcatgtgcccggtaaaagaagcaatcgagccacgcataagaccggatgggaggagcgtgtttcctgggtatacaggagaacttaagcctgccggggatggcgtgacatatgcacttaagaatacaagcgtcctggttgtgggaaagcattggggaggcttccaggatggcgtgatcgacatgagtggagagggacagaagtacaccctgttcggagaactgaataatatcgtactggtagcggatacgaatgagacgtttgagcatagagagcagcagaagaagaacgacgccttaagacgggccggacacaggctggcggagtatattgcctcctgcgtcaaagaactggagccagatgaaatggaagtgtttgaactggagcctatgatcaagagggacgcggaaacggagaaacttccttccgtcgtgtacgtgatgcagccccagtcccaaatggaagagatgggatataacgacctggcttacgggtgggatatgaaccatgttgtccctacggttatgcaccccaacgagattctggatggcgcaatggtttccggaagcttcatgccggtatcttccaaatggtcgacctatgatttccaaaattgtccgaatatcaaggcgctgtacagagaacatgggaaaaccatcaacttcctgggtgtcattatgtccaatctgaatgtagcgctggagcagaaggagcgctctgccctgttcgtggcccagatcgcgaagagtctgggagcggacggcgccgtagtagcagaagaaggctatggcaatccggacgcagactttatcggctgctatgtggcgttggaagacgcaggaatcaagacggtgggtatcaccaatgaatgtaccggacgtgacggacagtcccagccactggtgacattagatgagaaatgcgacgcgatcgtctcctgcggcaatgtatcagaactgattgaactgcctccgatggagacggtgctgggcgaactggaagccctgggaagagacggcttatctggaggatgggccaatgacgagatattagggccatcggtgaggccggacggctcgattattatggaaaataactcgatgttctgcggagaccgggtgtgcggctggtcgccaaagacgatgaaagaattctagaggagggtggaaggatgaagaaagcaatcttatatatcaatcagtttttcggacagatcggcggcgaagacaaggctgatttcgagccgcagatcagagagggaaaggtaggccctgcgctggaatatgccaagacgctggatgcccagatcacccatacgatcatctgcggagacaactatatggggagccatacgcaagacgcggtggatgctatcctaaagatgctggaagacaaagagatggatatcttcctggcaggccctgcgttccaggccggccgctacggagttgcctgcggtaccatctgcaaggcggtaaaggaaaggtatcatgtgccagtggttacctccatcaatgtagagaacccgggcgtccagatgttcaagaaagatatgtatatcctgaagggaggaaacattgcctccaggatgagaaaagacgttgcggcggtaacgaggcttgccaataagattctgaacggcgaagagatcggctgcgcgcaggaagaaggatactttgaaagaggaattcgccgtcagacatggattcaggaaggaaccccggcttcagaacgaatgatcgacatgctgcttaagaaactatcgggccagccctttgagacagaactgccgattccgaagatggaccgcgtgcctatcgcgccgccggttaaggatctcaagacggcaaggattgcacttgtgaccaccggaggaatcgtcccggtagataatccggaccgtatccagtcagcttccgctacacgctggggcagatacaatattgagaaggaagacgatttgaaagcaggagagtataagacgatccatgcaggattcgatccggcagcagcagatggggatccggatgtcatcacgcccatcgatgccctgaaggttctggaaaaggaaggcgtatatggcagccttcacccttacttctattctacggtaggaacgggaacgacccaggcggaagcgcagcgcatggccaatgagatgatcccttactttaaagaggaccacgtggacggcgtgattctggtatccacatgaggtacctgcactcgttgcggcgcaacgatggtcaaagagattgagaaggcaggattcccgatcgtgcagatgtgcaacctgattccggtggctaagacggtaggagcaaaccggatcgttccaacaatatccatcccgtatccgctgggagaccccggaacacctaaggaagagcagtggaagctgcgttatcacaggacaaaggtggcacttgaaagcctggcatcagatatcagcgaacagaccgtattccctgtctgatcctattatggatgaaaggggaatactatgaagaaagaaaagaatcaagtgttttatgtttctctgctgctgacaggcggcattgctatatgggctgtggcatttaatggcagttttacttgcgtatccaacgcgatctactccttccttacgacagaattcggatggctgtacttgcttgccatgctggcatttgtcatcttcatcattggcattgcctgcagtaaatatgggaaacttcgattggggccggatgattcaaagccggaatataagacagcctcctggtttgccatgctattcggggcaggcatgggggtaggcctggtgttctgggggatctcagagccggtatcccattatatgaatccgccaggaatggaaggaggcactgccgaggcggcggattttgccataaagtcttcattcatgcactggggaatccatccttgggccaactatgccatcattgggctggcgcttgcgtacttccagttccgcaagaagaagcctgcgctggtaagctctattttcgagccgctgatcggggagaagaaaacaaacggcgctttgggcaagaccatagacatattggcagtatttgcgacggtggcgggagttaccacttcgctgggactgggcgtattacagattaacagcggcctgggctatctgtttggaatcccgtctacgcttctggtgcagattgcgattattgcagtgattaccgtagtatacatatggtcggcggtatccgggatcgagaagggaatcaagctgatatccgatgccaacctctatatcgcatttggccttatgatactggcagtcctggttgggccgaaggtagaaatcatgaataattttgccaacggcctggggcagtatctgggcaatctgattcctgacagccttgccatcaaaacctatggggataacagctggataatgagctggaggatcttctactgggcatggtggattgcatgggcgcctttcgtaggcgtgttcatcgcaagaatatcaaaaggcaggacgatacgcgaattcattgtaggcgtagtactggcgccttcgttaggctctcttgtatggttcgcgatatttggcactttgggcattcatctgggagaaaataagatactgtctacggagacgcttcaaaaagtagcggcgactccggagataggactctttaccgtcctggaaaagtacccgatcggtatagtgctgtccgtgattgctttgatattgctatgtacgttcttcataacttcggcgaattcgggaacatttgtcttatctatgcttacctccaaaggagatctgaatcctcctaatagtaagaaggtgctgtggggaatcgtgcagtccctgatggcagtggggcttttgattgcaggaggcctcaagccgctgcagattatctccatagcggccgcgttcccatttatattcattatgctctttgcctgcgtatcgctggtgaaggctctgaagaccgagaatgtatcataagaaatagtctggaaagtggcgtcttgacgtgtcaagatgccactttcatttatgctctgttcgccttataatttaagcagcgaggtgtgagcatggaaggaatcttgaattgtacgatacccggaatcaaaatatgcatattgtggaggcagattgcaggaagcgctctgcttgcagcggtattggcatgcctgtatatctttgcatggttccagagcacggcatatgacagcctgccgcaaggacggtctgccagtcccgtgatgaacgcacagacgggtagagtcgtaagcgggatgtttccggaaattgcattgggaattacaaaaccaacggtagtgctgtctcttgatgagaggaaagaagaggcgggaatattcccggaagtgaatcagaaaaagaaagaggacctgaatgttcaggttatgacatcttcggactcccatccggcggagacgccgttgatagttgtctgcctatatggaaacggaggaatgccagagaagaccatatattcctgcgaaagccccaatatagaagtagatgcttttcaaagacccagaaggcttggcaaagaatttaccggctggtatctggatcctgcatgtaccatgccctttacaggtgtggaaggaaccccggtgaatttggcgttatacgcaggatggaaggaattcgacggctttgtgtccgatgagaacggacggatcattggatgtacaagctcatcggttgccactgacggcatcctgacatttccaagaagcatggattgtaccggaattgaaaggaattccctgggagggctggaagaagaagtgattgaggtctacattccttccaacatcacctatattgcgccgggagcctttgatcacctccatctcctgatgttcatcgaggtggctgaggataatccggcttattacagcgaggatggaattctgtatgcggcaggtggagagatcattgcatatcctggcggaaggtaggcttttgcctgttgcaaagaatcctgggaaatattataatctaggaaaatggcatttctataggatgatgcataagtataaatggagtgtggacatggggaagatattactgctggaagatgacgaaagcctgaatcggggaataagcctgaaacttaaaaaagaagggtacgaagttttaagcgccaccggagtgccggaggcgaaggagatgttccgggaaaatgaggtagacctgatcatcagcgatatttccatggaagatgggaatgggctggaatttggacaaagcgtgcgcaaggtcagcgatgtatacctgatcttccttacggcgctggatcaggaggtcgatattgtaaatggatatgatgcgggggcagatgactacattaccaagcctttcagcctgatggtgctgatatccaaggtcaatgcgctgatgcgcaggattgaaagtacgcacgaagagggaaatgtgctgacatctggaaacatccaggtctggtgcaaggagatgaaagtatttcaggaggagcaggaggtatctcttagcaagaaggagatccagttgctgctttattttctggagcatccgaagcagattatctcgaaggagcagatattagaatcagtatgggatatggacgggcagtttgtagatgacaatacggtgccggtaaccatcagcaggctgaaaaagaaacttgcgacagaagaagattatgaatacatcaagaatgtaagggggattggctacctgtggacgacagaagtattgaaaaaatgataaagagccgggaacagggatatatctggctggagcgggagttaaagatgaaacttggcgtaagtactgcattcattgcagtatttttctttgtaatgcgctgccttgaaccgaatttccgttattggctgccctttcttatagccgcgcttgtaatgaacggcatatggaattatttttcgtataagcgggaatacggcaattacctgtccatcagccgatatctgaatgcgtttgaagaaggggactatgattttcatacagaagaagattatatgaaaagtggaatccattcccagatcacagaacatctggaacggctcggaagcgcatttggaacacttcggaaccgtctggtggaggagaaggaaaatacaaaggcgctgatcacagatatttctcatcagttaaagacgccgattgccgcccttggcttgagttttgaactggtaaaggatgaagatatcacagcggcggaaaagatggaattcctggagcgtgcagagcaggaagtggggaaattaaactatcttctggggacgcttttgaacctgtcaaggctggaggcagacatgataagacttgagcctaaagaggccagccttaaggaaacgctggtccgggcagtcaatggcatctttatcaaagcaaatgaaaaaaatatagagatagaaatggaaagttttaaggatgtgagcctacagcatgatccaagatggacagcggaagcatttgccaatgtcctggataacgctgtcaagtattcgccggaaaagtctagaattcagatacgtgttgaacgtgaggtatcctacgtactgattgagattgaggatgaagggatcggaataccgaaggaagaatattccaatatattcaagcgattctaccgtggcaagactccggaagtggaggccatggagggggcaggcgtcggcctgtatctggtacgcgagatcctggaagcgcagggaggcagcgtgcgcgccctcccttcccacaggggaggaaccatattccagatgatgctgccaaaaaagaagtattctctagaataacaaaactgttattttatctgatatgttcctgtaagactcctttggtaggatagatacagacaaagaaagaatacccggtcgggtgttaggaaaggggttcaattatgagagcaatattagagactgtagatctggtaaaatattatggagatggagacaacatggttaaggccatcgaccatacagatatatccgtggagcgtggagaattcgtcgcggtggtgggccgctcgggctcaggcaagagcacgctgcttcatatgctgggaggacttgaccgtcccgacagcggcaaggtattcattgaaggaagggatatattcgggctgaaggatgagcagctggccatattcaggagaagaaagatcggattcatctttcaggattataatctgatgccagcattgaatgtatgggaaaacattgtgcttccgatcggattggacggaaaaagagtgaataaggattatgtgatgagcattgtaaagagcattggcatggaggaccgcctgactgccactccaagcatgctgtcaggcgggcagaagcagcgcgtagcgatcgcaagggcaatcgcctcaaggccggcgattattctcgcggatgagcccactggcaatctggactccaagacagagatggaagtcatctcaatcctcaagaactgcgtttccaagtatgggcagaccctggtcatgattacccacgacgagaccatcgcccagatggcagaccgcattatcattattgaagatggtaaggtggtgaaataaaatgaatattattacgaagaccgcaacatcgaacctgaaaagaaataaaagcaggaatattctgattggaatcgcgatccttctgactacgctgcttcttaccatcgtgccgacggttcttttagataccatcgacattgaatttgtagcggtaaataaggcttatcctacctttcacgcgatgtttcggaatgtagacgaaaagtctgccgaagaaatgcaaaaggatgaaagaattacgaaagtaggcctaagggaggatcctgcctacatggtgtgtagcaatccggatgtaaatatcagcatggtatattgtgatgccaaagctgccaagttaaaccggctgaagcttaaggaaggagatttaccggaaaaggcagatgaaatcgtcgtgtctaagcacctcctcaaggctatggggctggaaggagagattggcgatagaattacggtgccgtttcaggcagtagaagacggcgggcttgggatggaacaggtcaaggaatttaccattaccggctttagcagggattctaaagcggcgattgaaaaaggggtatattccgccatggtttctaaggcatttacagaagaaatcattcccgagggagctcataattaccgggtatatttccggatcgccgggccagagcgcatgacaacggatgcgatagaagagcagattaaagagattggagcggaatataagctgaatgccactgacatcgtagataatggagagtatctcaacgccaattatgtggatcccgctttatacagcgggatggcagggctgatggtcataatcgtcctggcgggcattattacgatctacagcatctattacgtgtccatgatgaacaaggtacaggaatatggaaaattaagagcgattggcgcgacaaaacgccagatacggaaactggttttccgggaaggcttcgccgtggctctgattgcaatccctatcggcctggcgcttggatcgctggccagcacatttatcgtccatggaatgcttgataccagcacgggcgtgagcaattccctggcgaagtatatgagggaagccgtggagtcatcagaagtaacgctggtcaagccgtggatacttcttctggcagccgtggtatctctggcagccgtatatctgtctctggtgcgtccgatgcaggtggcgagcaaaatatcagcaattgaggcaatccgctatcagggccagggaagcaagaagaaaaaggccaaagaaagaaaaggctatcaggaactgaataccaggaagttaacgatgtccaatctgggcaggaacaagaaacgtaccgtggttaccatagtgacccttggcattaccggcatcttctttatggtggtcgcgaccgtgctaagttgtatgactcccgaatccatgaccacccaggacatccgtggtgatgtgtccatttctctggacttcgagagtggaaaccagatgcatccggaaaaagaattatataagatacagcagaataatccgctgtcagaggagttaagagaacagattctggcaatcgacggagtaaaagagatcgaagtgcagacaatggttcaggcggtaatccaggaagtgctggaagaaggaaagccaatggagaccttcccgagaggcatcgaggatggcgcgcttgaggaactgaagaagtatgtggcagagggaagccttgacgatgcgaaattaaaggatggaaaaggaattatccttaattcagaaggctttctgttatcccagagcggaaaaggctttcatatcggagacaaggtacacctggatatcaaggatggagaagactccgtcagcagagaattcgagattgtcgcgattaccaagcacgcgccatatccattggcgggctacgatatatgcatgccaagttcggtacttcaggagttcagtaagaacaatctgacggacagatataatatcacggcagaaaaaggaaaagcagccgaggtcaccaaagcagtaaaagcgctggtagaaaatcaggaatttttggatattgaaacttatcaagaattatataagcaggcagagatgcagattggcttcatgatgtatggatgttacggactgctgctcgtattcggcttaattggaatcctgaaccttgtaaataccatgatcaacagcgtctatgtcaggcggagagaacttggcatgctgcaggccatcggcctgtccgggaaacagactgtgaacatgctgcagctggaaggcttgttctatacggcgggcacgctgatactgtcccttggcctgggaagcctactgggatatctggccttcctttgggcaagggaagaaggactgatgtctatccgcatttatcattatccggcagggccggcactgatgctggtagcggtggtactgcttgtacagctgctgatcacctatctggtaaatctcaactttaagaaatcaagcttgattgagagaatcaggtttgcagaataaaggatagaaaggaaagggatgaatcctcttggagggcttcatccctttccttatttacaatttagggtaatcgtaaaagattaagaatggtatcacgtacctgccgcacctggggcgagaggctatgatcctttgcggatatcagcgccagttcccagtgcacctcttctgctggaagcgggacgatcctgtaattgtctggctgacggtcctcaataaaagaatcaatggcgatgccgatcacttcctggtccggacagactcgtatcatattttctaccataaccgccgtatcgtagatcatcggctcaaagccgtggaggcggcagcgttcgcagaaataatggaagattcggaactggcggcttatcagcatcaggggataggggcgcaggtcatcaagccttatgagcggcttgccgtataatggatggccgtcaggaaccagcgcgcacactgcggaagtatgcaaaatatccgagttgaatttgacggcatccacaggccctgaggtcaaggcaagatcatagatatgatcgtacacattttcctcgcactgtaaatcccacgattcgatataactgatggagaagtccggatatttttcctggagaattttaagcaaagggagattgagtacctggtagacgcccagtgtagtgcctaggataacttcctttttgttaagttcggagaggtcttttcttagcaaggcatactcttcagtgattatctgcgcatgctttttcaggatttctccggacgcagtcaggatcagcccttcgggagtacggacaaaaagcgcgcactgaagttcatcctccagttttttgatggctttgctgactccctggggagagatgtataaaagttccgcggcttttgaaaaactgcaagttttgcagacagtcagaaaatataaaaatgatgtaggattcatagacgtccccccatgcgcatgaactaatagttgaagggttgaaacttttggatgttttacattctgtcaaatccagtataccatgaaatcagggagaaatccaaaaggaaggggatgataggatgaagaatttatttgatctgacagggaaggtggcgctgatcaccggcgcttcttctggacttggagtacaaatggcccaaggactcgcggggcagggcgccaaactggcgattgtggccaggaggatggatcgcctggaaaagctggcgaaagaattcgaggataacggtactgagtgtctgcctgtgaagtgtgatattacgaaggaagaagagatcattgaaatggtagataaggtgatatcccactatgggcagatagacattctggtgaataatgcaggaatggcatctggaactgcatcggaggatatgacgctggaggaatgggataagattatacggctgaatctgaccggatcgtttcttgtatcccgggaagtagggaagcatatgattgccagccgatatggaaagattattaatacctgctccatccagggaatccgatgtaccatggggatgccgggaactccttacaattcgtcaaaaggcggagatatcatgatggtaaggtctctggcagcggaatgggcgcagtacgggattacggtaaatggaatcggaccaggatattttccaacggatatcgacaaagaatatctggcgacggattattttaaaggacagttggccatgcattgcccgatgggcaggattggacgggacggcgaattgaatggagtcttgatctattttgcatcggatgcatccagttatacgaccggacagatcatgtatgtagatggcggctggacgcttgtttagacaattcccccataaagcgatataggtatagaaggacgggcacgcgattgcatgcccgtccttctatgtgatacttaaaagtcaatccgctttctatcagcctattccgagagagcagagtcatccattgctgtggaatcgccgctttcaatcacttctccggtatccttgtttttgaagtttacaatcgtttttaactggtcttctggcaccgcgttcaaagactggtacatattgccctcgacatacagcgcgattacgacaaaactttccagcccgccgtatacggaagcatctacattaacatcgaactcggttacttcatcattgtaggtaatagagtcaaaagaaggatagttttctttgtcctgcagaatctcctggatgctctcgtcaattccagtcttaatctcatttaatagattctgatgtgcctcttctgtcattttgagagttacggacccatcttcattcttggttacctctgttacgccggcggcttttgcctcctcatccaaagtggcttcggaatctccgaccaatgatgccggcagggtgatttctaccgtcttctgttcctttttaggcgctgcctttttctcagaagaatcttcagtcttttctttctttgaagtatctttggaatcgtccttgccctggcaggcagccaaagacagcgtcagtaccgcaatcatcagtactgcgatcaatttctttttcatagatatttttcctctctttccttatgtgtcggtcttacagtttgttccggtaatgcaaaaatagtttacattttctatgtcggctgctttttatagagagcaggaaatgaccggtataaaccttgctattaacctctggcattttctaagaccatattaattatatatggtaaattgatgaaagtaaacgggggcatttgtaatgccatataattccataaaattacagtttgaaattcggtattccgaatttgctggttgacataatactttttaaagaatataattccgatatgaagttcgaacttcagaatcaatagcggcaccttgaaaatagaataataagacaaagcggagcatctaccagtacataaaaagcatttattctggcatactaattccggggtgatagtatggataaaaagcagcaggagaaacagaaccggcagaagaatctggatcaatacaacagtgtgaccgagaaggtaaagccggagaatcaaaaccaggagcataacgcaagaaaagaagcagtagacgtgaaattgagacaggtataagactggaacaaagcaaagaaaggcatccgcaatgggtgccttttttgcgggcaaaaaggaggaggggaatggaaaatgaaatagcagtggccatctgctctcttgtcggaacgttggttggaagcctggccggaatcatgacggcaaaccggctgactaactataggattgagcagctggaagaaaaagtgaagaaacataacaatctggtggaacgtatgataatagtggaacagtccacaaaatcagcgcatcacaggattgacggattaatagcagaaagagaggaataggatatggaacagcttatggattatgtgaaaccagaactgatcgtcgtgtcggtagcgctttactttatcggcatgtggcttaaacaggcagcatttatcaagaataaatatattccgctggtactgggaatcgtcggaatcttcatatgcggtatctgggtaatcgggacagaagccactactacgaggcagggaattgcaatggcagtattcaccgcgattgtgcaaggcgtattggtggcaggcctgagtacatatgtgaatcagtttatcaagcaattgggaaaagacgagtgaaatataataaatatggcgcaaaaaccggaggaaattttacatcctccggttttgatgtcttaaaggagtagaaaggagcaaaaattatgaatataaaaaagcacggattaaggtttcatggcagttttacctacaggaacaggacggatgagatcatctggcatcacgccgaggcgaactgcacggtcgaggatattcattcctggcacttgaacaatggctggatcggatgtgggtacaacctgatcatctacaaggatgggacggtgcacgagggaaggccgctgaacgctgtcggagcccacgcatcaggccacaacagccgcagtgtaggcgtctgctgcatcggacgttatgatattgagacgatgccgctggcgcaattaaatgcggcaaaacaggtgcaggcctatttaaagggtctgtatccaggggcggtaacgaagaagcataaggatgtaaatgccacctcctgcccgggcaagaattttccgttttcagagattgtgggaaccgcaggggatgcgtccaccgaggcatccgcagcaggccaggggacaagcccttctggcaactggtacgcgcgcctgcaggcagaatgtaatgcgcagggatttagcagccagaaggtggatggccttcccgggccgaatactctggcaggatgcccgcaattgggaagaaattcaagaggccgcatcacggccctgatgcaggagaggctgatctcgcttggctattcctgcgggccttgcggggcggatggcatcaatggcgcgggaacccaggcggcgatcaaggcattccagagagactatggattgataacggatggaatcgtcggacagaaaacctggagcaagctgctgggtttatcataatcgcattatcaaggccacggggcgttaagaactccgtggcctatttcatgtgatatttcgtgttgtataagggcatgttttcttagtcaaaaagaaaatatgccctataactataaaatccgcaatcccatgaaaatactggacttgcggagttatgtaagaaaataaaaagatggagtatacgggattcgaacccgtgacctcaacaatgcgaatgttgcgcgctcccaactgcgctaataccccatggaattagtataacacgtacaagccaaaagtaaagagctgcattaaaaaatatttgaatttgtgccgcatgtaaagacaactctacctcttctttattattttgttcaaaattaaagattgcaaaatagaaaacttgacaaatcatttttatatccatatacttactaatggtaattatcaatagtaaatacatggaggaactatgcgtacagaagttttaaagcagttattagatgcctgtcacctggcaaagaaaagtatagagactatgccgaaactgcctaagggcatgaagccaaggcatgtccatgtaatggatgtaatcggagaaatggaagattccaaaggattctgccgcgtgggggatgtcagtgcgaaaatgggaattacgatgccaagcatcacgaaactgattcaggaactggaactattaggaatggtagagaagtatcataaggaagaggataaaagggctgcttaccttcatcttactacgaatggatggcaatgtgtaaggcagtatgtgaccgaacttcatgggaaatgggcggctgcacttgaagatgtgacagaccagcaggtacaggatgcagtttttacaatccaaagattatacgagacgatatccagagaaagcgggggcggctatggcagagaagaataaaaaagaagtatcatttacgcaaggtcctatctttggctctattgtaagatttgccctgccagtgctgggggcccttgtgctgcaggcagcctacggtgccgtagacttactggtggtcggccagttcggggatgctgccagtatatcggcggtgggaacaggaagcgcattcatgcagatggtgaccttcatccttaccagtcttgccatgggctcgacgataattatcgcccagcatatcggggagaagagacctaaggctgccggagacgcggtagggacgacgatcgtactgtttcttatcattggcattgcgcttaccgtgattttagaaatctttgcgggaaatatcgccgagatcatgcaggtgcctgcccaggcatatacaaaaacggttgcctatatccgaatctgttccggtggaattctggtgattattgcatacaatgtgatcagcggcatcctaagaggcgtaggaaacgctaatctgccttttttgtttgtaggaattgcctgtgtggtaaatatagcgggagacttgcttttggtgggcgtctttaagatggatgttgccggagctgcgatcgcgactatagcggcgcagacggtatcggtagtaatatcagtatttgtacttaaaaagcaggacctgccaatcgcattttccaaagagcagtgccgcatatcttcaatcgaatgcggaaagatattaaaaataggcgtaccgatcgcccttcaggagacgacggtccagatatccttccttgttatcaactcgatcatcaatcatatgggcctgatgcagtcggcaggatatggcgtggcgcaaaagatcgtgtcattcatcatgctggttccttcctccgttatgcagagcgtttcagccttcgtggcgcagaatgtaggagcaggaaatctggagagggccagaaaaggattcctaactgcgatggcatctggatgcgcagtaggaatcttgatctttctggccggcttttttggcggagaatatctgtcagcgccttttacctcagacagagaggttattgtgcaaagcgccagctacctgaaaggattttcagtggactgtatcctgacctgtatattattcagcagcatcggatattttaatggccagggcaatagtattccggttatgatacaggggataacctcggcgttctgcatcaggataccggtatctgtcctcatgtctaagcttccgggggcatcattgatgatggtcggcatggcgacaccgatcaccacggtatatggcatcctattcttcctgatctgttttcggatatatgggaagaagaaaatagcctgaaaagatatattgacagaaaggaattcatagtttataattgggataaatttttagacagaggtagtttatgttaattgtagggagagtcttttagacaatgaattgaagagttgagaagaggtaactataggttagagatatagttatgttctttttgtctgccttacaagatgctaacatacacttctgacagagaacggtaaatggaatgataaagcatggctgtatggtcatgctttttttgacctatttttatagaattctatttaagatagctcagtccgataacgccacagaagcggtatgcccatacaaaggcagaagtttttgtggcgtttataaatatatgatttgaatggagagattgaaatgacagatacagaaaagatattagaatttgatcggataaaggaaaaactggcagaactggcatgtacagaaaaagccagacagcagatacaggaactgaagcccagtttaagcgagctggaggtaaaggcctctcagagagagactacggaagccaggaaaatgatagagatctgcggaaatccgccggtcacagcactacagggagttgacgaatggatagaatttgcgtccaaaggcggctgtctgactcccacgcagctggaacagatatccatggtactggctgcggtaaggcggctgaaggattatttgcgcaggggcaaggagcatgagataggcctggcttattatgaggagaatctggacggactcgacgacatccgggaggaattgggcagcaagatcaggaacgaaagggtggacgattatgcgtccaaaacgcttaagtcgctgcgggaagcgattgatcgggcggagacaaagatgcatgaaaaggcagacgctatcctgagggtaaataagcagtatatggcagataatttcagtacgttaagaaacgggcgcatctgcataccagtaaaaaaggaatataagttcaagatccaaggctccgtcatagataaatcgtcaacagggagcacgctgtttatggagcctttgcaggttgccagactttacgatgaagtgcaggaattgaagattgacgaagaaaatgaggaaatccgcattctgtatacgctgtcttccatgctgtcggataaggaagagataatccagtcaaacagccggaccgtagaaaaactggacttcatctttgcaaagggcaagctaagtctggaacaggaggggattcagccggagataaatacggacagacatatccggatcaagaatggaagacatcctctgatggataaggcagtgaacgtaccattgaacttcgagatcggaaacgggataactggggtgatcattaccggtcctaacacaggcggcaagacggtggcgattaagaccgtggccctcaattgcatgatggcccaatgcggccttcatgtaccctgcgaggaagcggagatctgtatgaataatgcgattctgtgcgacataggggatgggcagaacatctctgaaaatctgtccacattctcggctcacatcacgaatgtcctggacattctcaaaaaggcaggaagagatagcctggttgttatggacgaactgggatcagggacggatccggcagaaggtatggggattgccgtagccatcctggaagaattaaagaagagcaatgcattattcctggctaccacgcattatccggaggtaaaagagtatgcccgcagaacagaagggatcatcaatgcaagaatgacctttgataaggaaagtctgaagcctctttatcagctggtcatcggagaggctggggagagctgcgccttttatatcgccgggaaactgggaatgccaggatacatgttgagcagggcggcaaaggcggcctatggcagcgatggagaaattaaaatagaaggaatggaaggaaatgaagaattgaagaaatcttctcatccgaagatacagaaaataaagaaggctgtcacgcagaaagaggccaagaagtaccagattggcgacagcgtgatggtatatccggagaagaagatcgggatcatatgcaggatggcagatgaaaaagggatgcttcaggtacagatgaaaaaagaaaaaatgtgggtcagccataagcggataaagctgcatgtgccggcggaacagctttatccggaagactatgatttttctatcatatttgacagcgtcgagaaacgaaaggcgcagcatgacatgaagcgcaaatatgtggacaccgaattgacatatgaagaataaagtagatctgcccccttggagccctaggagaagggatattggatgacaaagtcagtgaaggagcgtatggccggataatccagcagttccttaagcgtgacgtagtaaatggtacgaaggagtacatcttccaatggaataattctgcagtcctccgttttcagggcctgcgcgatagagtttgaggcaaatcctatagccaggttctggctggccagctgcatgacgatatcagactggcttgtctcgcaaaggatgcggggcgcaatataatgctgatcgaagacctgctctaattccttgcgaaatgcagactcttttgcaggcataatgatattttccgattgcaaatcctgcatggaaatatatggctggccggatagcggattctgccgggaaacaatagccacataacggtcatccataatccggtggaaaaatatatcttccttatgctgcaaggctgcctcggaactgattacaaacgccgcgttgatagagcgggaatccagcatctgcagcagcgtattgctgccgtctacggtcagcgaataggagatgcccgggtaaatgcggtggtaatccgtaaggatatgggaaagattcagatagctggcaacccacaaaagtccgatgcggagggttccgttctgaagctggctgtgcttctgcatcaagtccgagagttgatcgacttcatttacgatacgtctggcagactttagaaactgctctccggcatccgtcagggtgacggatttgggatggcgcacgaacagggcaatgcccagttctttctccagattgatgatctgctgggacagggatggctgcgcgaggaataatttcttcgcggcggcagaaaaacttttattttcagcaacagcaagtacgtagcgtaattggtggatttgcataataaatctctcctcatgaaagtgaatagcgtgccggattaggcattcctacgaaaattgaaatacctataggattaaactatcgactatataatatatgaatattttacaaatagcaagcgggcagatatgataaacctatcaaaaataaaagacttgaaggatgagaggagaagaaggaacatgggaaaaagagatacaaaagcaaatgtattcttaatactggctcttgcagttattataggggcaaggcttatgccgggaataggaggattgtcggcggatgcgatggcagtgctgggagtattctttggatcattaattatgtggatcgggatatccattgactggccaagcatgatcacgctgctggcgcttggaatcatacctgtatttggattttccggcacctttgccggagcctttggcaatacgacggtggcattcttgatattcacgttcatgctggtatatccgttgtcaaagacaaattttgtgagaagatgtacgatttcatttatcacgaacaaaatcgcgcgcaaggggccatggtattttatctgcttcctgtttgcggcagtgacatttatgggattattcatttccccttccgtgctgtttgtcgcattcatgccattcctggaagatatcttccaggtgctggaactaaagaaaggcggaaaggcagccaatgtaatcatgatgggaacggcattctgcataagcctgtcctcaggcatgactgccattgggcatgtgtggccgacgatggcgatcggctactatacggcagcgacgggaaatgacgtgaaccaattccagtatatggcaatggggattcctacgggaattattctgattatacttttgattctggtatttaagtttctctatcgcccggatgacgtaggggagatacggccggaaaaagcaatgaaccttcgggggactgtgccttcggctgaccgaaaggaaaagattattctgggagtcatgtttctgaccgtcttgctttgggttgcgccaagcctgatcaagggaattctgccggaagtatatacgatggtaaacagctggtcaacggcaatgcctccgctattgggctgcgtactgctctttatcttccaggttgacggggaacggattatgaacttccgggaagttgccagcaaaggcgtattatggggcagcgtactgatgaccgcggcagccacccagttaggcgcgtgcctgaccaatgaggacattggcatcagtacatggctgactggaacgctcgagccgctgaccaaaagcctgcctgtgatcggattgatattattcttcatgacatgggcggttgtggaaaccaatttttcctccaatattgttacgacgacggttgtcagcgcggtcgcgttatcggtactgaccgcgttgccagaaggttctgtcaatgttggggcagtagtgtgcatggtaggatttgcggcaggaatctgcaatatgactccggcagggcagagcacagtcaatacggttgccattggctcaggatggacggatacgaaatccatgtttgtctggggcggggtatttgcggtaatggcgattctggtgctgagttttatcgcatatccgttaggatcgctcgtaatctagggaacgctaaatagcagggaggaacagtattgtgagaggatatcagtatgatgttgtggtggcaggcggaggcgcagccggcgtggcggcggcagtaggcgccaggaaggcgggagccagaactcttctagtggaaaggaatccttatctcggaggcgaggctacccattccggggtagcggccttttgcggattctatacatgcggcagcaaccctgtgaaggtagtagacggagttggcgggctggttttaaaggaaatggagagtctggggccaaccctggattatatcgtatctccgaccggcaacaagaatattaatttccagccggaatatctgaaatgcgcgctggataatctggtggagaaagaagaagtgtcctgcttcttacatacaagaatcatcgcggccaaggcggaagacgggcggctatgctcgatcatctgttctgacgatgaaggcgtatttgctgtggaagcctcctgttttgtagatgcgacaggggacgcgaacctggcccatctgtgcggtgcgaaaaccgtatggggggatgaacaaggatatgtccaggccgctacccttccgtttcgcctcagcggcgttgacacgtcctgcgatatgtctcctgccgcagtagaaaaggctatcgtgaaggccaagcaggaaaggattccgtatttgaccaaagaaaaagggttcatcctaaaaaaagagaattccgatacagtggtggtacttctccccagcgttattccggaaggcttagacgctgaaaaacggaccgccatagagcgggatgccagaagacaggtcctctattatgtacaggctttgcgcaagtatatgcctggaatggagaactgcgaactagcggtaataggaccggcagtaggctatcgggagaccagaagaatggctggaaaggatcaggtagtcacggaagacgtcctgagaaggcgcaagcgcgaggacggcgtggcaagaggaggctggaagccggagatccacaaggatgtcaacaagatggcagattatatggaagtagaggagggaagctactttgacatcccgatcggcgcgcttcaatcagtaaatattgaaaatctgtatggggcagggaggatcgtttcttctgaagaagcggcatttgcggcagtgcgcgttatgggcacctgctttgccaccggacatgcggctggcgttggagcggcagtacaggccaggactgggcaggcagagatcgaagagatacgccgggaactaatggaacaaaatgcattgatatagacagatggataaaggagaaaacagtatgacgttagacgagatccgtgtacggatagatgcaatagacacgcagatgaagccattatttgtaaatcgtatggaatgcgcggcacaggtggcggcagcaaaggcgaagataggaggagacgtattcgtattggaacgcgagctggcgattatcgaaaaacgcgcatctgatattggcgctgatatctatgatgaatatgtagcatttcttagacacatgatgagcgtaagcagaagatatcaatatgggattcttacggatatgcaggagagagtccttaaagacgcgattgaagagtccggggttgacgggggcaagcctcatgatcaggtagaaatttcatttacctgtaaaaaagaagcaagcgatcttaacctgtttatgaatatgataaaattgaatatgattgagatagacagcatgaatcttacgtcaaaagacggcgttcagacgattgtcatgacacttgacggcaatattcatgacggcaatatgaaacgcctgctctgccagattgggaaagaggcggatggattcaggatccgggctttaaagtagtatcctgccgtatctacgcagcgtaggttgtaagtataaaactcctgaattaagatagagacagcgaaaggaaaggagcgaatatatgaactacgttacaggaaataccatcaaaaggctaagagaaaaaaaggggattacccagaagcagctggcagatatgctggcagtcagcgataagacggtttcaaaatgggagacggataaaggtctgccggatatcggtattattaaggaattggctgaagcgctgcaagtatctattgcagaactgctgacaggagacgtggtgaaaaacgagaacacttcagggaacatgaagaaaatgagtttttacgtgtgccccatctgcgcaaatgtgatacagtcggttggcgaaggcgcattctgctgctgtgggatcacgcttcccaggcttgaagaggaagaaaaggatgatatccatatgccgcaggtggaagttatggacggtgaattccatgtattcctggagcatgagatgaccaaggagcactacatctcattctttgcatatgtgacatccaactatgcccagtttgtaaaactgtatcccgaacagaacgcagaatgccgctttaccagacgggggcatggcgctgtctatgcttattgcaacaggcacgggctctataaagtgctggtctaatgtgtctataaggcatccggagggacattccggatgccttttcattatagatggcgaatagcaaaacttatttttatacgaatcgtaaattatgatagaataaaagtagaaatgatagattttgcatcgttttctgaacactattggcagttagggatcttagaatggagatgcatcctatgaaaaagatgaaaatggaatataagaaggctatggcaaatgatacgggaaggatcgtaagcctggtacatcatacgatcatgacggtctatccccagtattatccggaaaaagtggtggattttttctgcggccttcactgtgagaaaaacatcaggcgagatgtggaaaagggcaatgttggcgtcgtatattccggggaacggctggcgggtacgggcagttttgacggaaatcatatcacaagggtatatgtggctcctgaatttcaaagacagggatacggcagttttatcatggagcagctggaggcgcggatcggcaagtatcatgatgagattattctggatgcctcgcttccggcaagcacaatgtacgaaagtcgcggatataaaacactgaggcatgaacgtatagacgttggcggcggggttatgctagtctatgaggttatgaaaaaagagcgcaaggaaagatggcttacgtgggcggtcgaattgcaaagtcttgcccaggcaggcctgtactatgcgcaggaccggttcgatgtggagcgctatgagagaatccgggagatctctgcggaaatggtttcttttaaatcagaagtgggtatagagaaggtaaagaatttattctgcagcgaggcaggttaccagacccccaagctggatacgcgcgcagcgatattcaaggaggataaaatcctgcttgtcaaggaaatgaatgggacgtgggcgctgcccggcggatgggtggatgtggggctatccgtgaaggaaaatgtaataaaagaagcaaaagaagaggccgggcttgatgtcacggcggatatgatcattgcagtacaggatcgggagaagcataatcttccggcatatacatacaagatatgcaagatatttgtactgtgtacctccattggaggaacatttaagaagaataatgagacgatagacagcgcctgcttttccttggatgaactgccggagctggccatcgacaagaatacggaagagcagatcgccatgtgttttgaagcataccgttcaaagaattggaaaacctacctggactaacgccaggataaaagcaaggaggagactaaaatgtcccaggatagaacctacatctgcatagatttgaaatctttctatgcttccgtggagtgccgggagcgtgggctggatccgctgacgacgaatcttgtggtcgccgaccctgaacgcacggagaagaccatctgccttgcggtctctcctgcgatgcgtgccaggggcgtacccgggaggtgcagagtattccagataccgccggacatcgattatatgatggcgcctcccagaatgcagctttacattgactattctgccgacatttacgcgatatacctgcaatacatttccaaagaagacatccatgtctactccattgacgaagccttcatggatgtcacggactatctgcctatgtaccggatgtctgccaaagaacttagcatgaagattatggaagatgtgtatgcagcaaccggaatcacagccgcatgcgggataggaaccaacctgtatctggccaagatcgcgctggatatcaccgcaaagcatgtggaggaccatatcggaatcctggatgaagaatcttacaaaagaaccttgtggagccataagccgctgacggatttttggagaatcgggtccggcattgccaaacacctggagggggcgggaatctacacgatggagggcattgcgaaagcggatgaggatatgctgtaccggatgttcggcatagacgcggaattgctgatcgatcatgcctggggaagggaaacgaccaccatagccgacatcaaagcctacaggcccaaggaaaattctatctcaagcagccaggtgctgggatgcgactatgactttgagggcggaaggctgatcgcaaaggaaatggcggatctgctctgcctggaactggtggagaaagggctggttacagactctatttctttatatgtaggatactccagacgcctgcagaagaagtccgcccatgggactatcactatgcccgtaactacaagttccgcgaaaaagatcatgggctatacacaagaactattcgaacaaatcgtcgataggaatgcgccaatccatagagtgacgctggcattcaaccgcgtggtggatgagatgtaccagcagtatgatttatttaccgatcctgcggagatagaaagagagcataagatacagaaaaccatgtttgagatcaaagagaagtttgggaaaaatgctatccttaagggaatgaatctggaaaaaggtgcaaccacgatagaacggaacaggcagattggaggacataaaagtggagaataaaatgagccgggaagaccgggcaaagcagtttatgccttttgccgcattaaagggatatccggaggcgctgcgcaaaaaggaaaaggtggttgttcagaaggtagaactttccgaagaataccaggaagaattaaacgttaagctctgccaggtgcgaaaaaatgacagggtgacggtggtctatttttgcaaggatgaatatttgaaactgacgggaatggttacaaggatagatgagacggccagagtgctgaagattgtcaatacgaagattgcgtttgaggatatctatgaactgatctgcgaggagagtcggagcgaaatataagtgggtataatcgaagaattagcagatggattggaggcgcgtatgaaaaatatcaggaataagaaactagtggctgtgatagtgctggctgcattcatcggcgttctgcttatgaagtttccggtgtggcgatattttatggcccagccatatgaaatgtcttttggcaaggaaacattaaaagaactggcatattcaggagccctaacggataggcgggcagcgagagaggtcctggtcgaggcagaagaagcattttcggcaatagggctgagttttgagaaagcagaagacaagtttggccgattggccaagtatacatatacatctgacagttatcctgacgctgtaaaagaaaagcataaactgaaattatatacagccaagtatgaaggcaaaagcggctatctgtggatatgctttacgcaagaggcatatgattcgaaaggaaaacttatatcaggcgcatgggataatctggccagatgggagatcaaaaaggatggaaacggagcatggcatgtcagttcgatcatggaagcggtataaaatgaaaagaacaagaatatatgttcgaaaaacaattgagttgttcctggttctatggtattctagggatatgcaaaagattctacatatactgggacttgtaaaagcgtgcaaggaaatgacgagggataatgaacagtagactgtggggattaaagatgacaaggctccgcagtctttttatatttatcggaagaggaatctgctaataaaggaggcggcatatgcatttaaagaagttggaacaggatttttctgtctgcaaggtagagaatctgtcaaaggtgaatttggatagcgaattctgttttattggaaagacggatgaggaacgatcggtcgtatgcgtaacgacggacgttccctgtaatgtcgtagagagggaggatggctggaaagcctttcgcatagagggaactctggatttttcgcttgttggcatactgtccaaggtgtcgggggtgctggctgcaagcaagattggcatatttgccatctcaacttataatacggactatatcctgaccaagtcagataattatgacagagccatagaagtgcttgaacaggcaggataccagtttatatagacgggagagacagaatgatcaggaacggaggtgatttccatgtccatgtggaatccctggcggggctgccacaggcatagcgaagggtgcagatattgttatatccataagggggataagaggaaagggattgataccgggcaggtggtgcgtacggagcaattctatgcgcctgtggaaaagaccaagtccggcatctataagatgaagcctgggcagacggtgtatctgtgcttttcttcggacttcctggtggaggacgcggacccctggcgcaaggagtgctgggagatgatgcgggaaaggcaggatctgcaatttctcttcctgacaaagcggatcgagcggtttgccgcctgtatgcccgctgactggggcgacgggtatgagaatgtaacggtgggatgtaccgttgaaaatcaggagatggcagactatcggcttgcgattttccaggaactgccgattaagcataaaaatattatctgccagcctttgattgaggcgatcgatatcaggaaatatctgggcggagtggaattgacggtggtaggaggagaatccgacaaaaatgcccggcccctttcctatgaatgggtactatccatccggcagcagtgtatcagtcagaactgcgcgtttgaattccggcagtgcggcactcattttataaaagatggaaaacaatatacgcttaaggtaaaggatttgggaagccaggcgaggaaggcgaatattaattggaagggatgttgagatatgagtaataagtatgaactgattgacgaaaagaactggaagcgcgctatgcattgcatggtatttagggatagcgttgaaccggcattctgcgtcacgttcgaattggacatcacgaagtttttaaggaagataaaagagagcgggtattcatttaccatggctatgatctttgttgtgtcaaagtgcgccaatgagatagaagaatttcgctaccgttttgttgatggccaggtagcgctgtttgagcggattgatacggcgtttacctaccttgatcaggatacggaattatttaaagtagtcaatgtgcctatgcaggataccatggaggattatgtagaactggcagccagtacggcaagagaacagaaggaatattttaccggaccgcttgggaatgatgtattccaattctccccaatgccttgggtatcctatacgcatatctctcatacgaatacgggaaagaaagataatgcgacgcccctgtttgactggggaaaatattttgaacgggatggaaaggtgcttcttccattctctgtacaggcgcatcattcttttgtggacggcctgcatgtgggacggctggcagaagcaatccaggactatctggatcagtagaaggtagagaggaggtaagagggatgtgtagggagtgttatgcagatgacaacagagtcacgcctctattgaatccgcaggattgtctcaggaaccatacccagtatatctgtggatcctgcggccgctgtatctgtatcgagcaagacggcaagcgagggcttcggaggtggaattttccttttaagacgctgggtattgcaaaactttatctgcgcactgcggattatactatgaagaagccctgcgggatttatgagatcacgaatgcaaaaggcagagtctcttataagatatttccaggggaggaagaattgcaggcttttttgaaaaagaacaaggataagtcctgcaacggcatggcgccggtattccgacagaaggagtatcacgaattcccgggcacgcaggtgcgcaagatgacagcggaagagatcgaaaggtatatggatgaacggcaggcagctgggacttatatgccaggattagcaacacaagaataaaatgcagacaggaggatcgcacaatgatgaaagatccgcaacagacgattggcaatatggccgacaaatacagcactgccctgattagttatatagacgaagaggggtaccctgtcacaaaggcaatgcttaagcccagagaacgccggggaattaaggagttctggttcaccaccaatacttcttccaacaaagtcaaatgctttcggaagaatccaaaggcaagtatttattttgtagataagcggtacttccgcggcgccagcctggctggcacggtagaagtgctggaaactccggaggcaaaggaaagaatctggcgcgatggggataccatgtattacccggaaggcgtgacggatccagattactgcgtgctcaagttcacagcagtgaagggcagatactatagcaactttaattcagaggacttcgaaatacaataacgattacaggagaaacggataatatggacaagaagatcgtatgtctcggagacagtctgacatttggaagcgtaggatattcttacatacgttttctcaggcatcccttagaggtaattaacaaaggggtgaatggggatacgacctatggtgctttgaagcggctaaggaggattgtcgcttatccagagtatgaagcggcagacacctatattgtcggcattgggacgaatgacgtattgctgccatatctgacccggatatcatggttgtggaaactacagatgggaccaaagtgcaggcggcttcaatgcaagacggatatgaaagagtttgccgttgaatatgaaaagtatctgatacttctggctaagaggcagaaaaaggtaatattgataggaatgccttatattgagttgaaaggttatcctcatgaatcgataagaatcagaaataagatcattgggcgcctggcaaaaaagtatgaggtgccatttattgatatttatgctttgcagatggaactagcttcgcagccaggggagtatacgtggaagcataggaatctgacccgcttgaccgaaggtatatttatggcagtacttccatttacaaaggactggtttggacggatgcgaggactaaaacttacggtggacggcgtccactataatacggcatcagccaaggccctggccggggaggtacaaagacgtttggacgaattggagaaggagagaaatcattgattaatcagaaagaaatgaacaatatttatgataacgaacagttcttcgagcagtatgcgcagatgtcgcgcagccgtcagggactgtccggggcaggagaatggcatcagtttaaggatatgtttcctgatttgacgggaaagcaggtgctggatctgggatgcggatatggatggcactgcaagtttgccgtagaatgcggcgcaagccaggtactgggcattgacctgagcgaaaagatgattcaggaggcgcaaggaaagaatgcagaccctaagattcggtacgaagtctgcggattagaaacgtatggctatccggcggactcctttgactgcgtgatctctaatctggttctgcattatgtcagggacctggatgagatctatggaagggtctatagaaccttgaaggaagacggcgtattcctggtgaacatcgagcatccggcttttacggcggggatcaatgaagactgggaatatgataagaacggaaatccaacatgctggcccattgataattatttttatccgggagagcgtacgacccacttcctggggcaacatgttgtgaagcagcaccatacgctggagcagatcttaatgggacttttgaatgcgggatttcaactggaggcagtcaaagaggcctatccttctgaagatatgatggagattcccggcatgaaggatgagatgcgaaggccaatgatgctgctgatcaaggcggtgaaataaaggctggattcgatacgggaggtgtcatgagatatagtataaggcaaatgaaaacttcggagtatccgcttcttgcggagtttttatacgaagcaatcttcgtaagagaaggagaagagccagctccaaggaatatcatagaaaagccggaacttcaagtatatataaaggactttggctcggataaggacgatcactgcttcctggcacaagcggatggaaaagtggtcggcgctgtctgggtaaggaatgtaaaagggtatggaaatattgacaattcgacgcccgagtttgcaatttccttatataaggaataccggggatgcggcattggaacggcattgatggacaggatgctgcaacatctgcgggaagccggttatgagagggcttccctggcagtacaaaaggataattatgccttaaagatgtatcaggcagcgggcttttatgtggtaggagagaacgaagaggaatatattatggtgaaggatctacaggctgattatgaagcggatatccgggagatattgtcccacaggaaagataatggcgcggatctttggactacgccggacaagaaactcttaaaaggcgcgccgtttaccacgctggagagcgtgctttatctgcgggaactgggcgttcccgcagatgatccagtgctggaagatgcggcgagcctgatctttagcacatggaaagaggatggaagattcaagatctctccaaacggcggaatctatccttgccagacggcgctggcagcggtggcgctttgccatatggggtatgccgccgacccgagggtgcagaagacattccggcattttcttgatacgcagcagccggatggcggatggaagtgtaacaagtatagttttggcagagggcctgagacagagcattctactccctataccacgttagagatactggacgcattccgctttacggatagaaaagaagcaggtcccgcgcttgatcaggcggtagagtttctgttaaagcattggcagatccgaaagcccataagcccctgccattatggcatagggacgctgtttatgcagatcgagtatccgttccgcggatatggcctcttccactatgtctatgtgctgtcattttatgaatctgcgagaaaggatgacagatttaaagaagcgctgggagcattggagtccaaactagcgggcgggcagattgtcgtggagcgggcagttcctaaacttgcgaaattatctttttgtaagaagaacaagccaagcaagcttgccacgtaccggtatcaggaaatattagagaaccttgaatagcaagattgcaagggcctatgggaaacgggaagaaataacgggggtgttgaaagttgacggagagaaaagacgttatctcccactgtctgacatataagagcgtctatgaggattatcctttccgggataagaattggtgcgtgatccgccacagagagaatcggaaggtctttgcctggatatttgacagggagggctatgtgtgggtcaatgtaaaatgtgatccccagtggagagacttctggaggacggcctacaattctgtggttccggcttaccatttaaataaggcgcactggaactcgatcattctggatggaacaattccggaaaaagagatcagaaggatgatcggggagagttacgacctgacaaagaaagagaggaagggataagaagatgtatgaatcaagatgcgggattagatgcgagaagtgtgagggaagagaagaagtgcattgtaacggatgcctgaatatggaaaagccattctggggcggcgaatgcagtgtgaagagatgctgcgaggagagaggattaaaccattgcggcgagtgcgaggatttcccgtgcgaagttctttcatcgatgggagtggagaaagggtatgatccaaagccgagacttaggcagtgccgggaatgggcaggcatcctggaaaccgaacgtctattcctgcggccttggagggagtcagatgcggaagaattatataaatatgcgaaggaccccgaagtggggcctatcgcagggtggccgatacataccagcatagaggacagccgggagatcatcagaacggtgctgtccgcgcccggaatctatgctgtggtattaaaagaaacgaacctgccggtgggaagtattggactgacggcaggggctgccagcaatatggatctgggaccggaagaagccgagataggatattggattggagtaccctactggggacagggactgattccagaggctacgaaagaaatcatgcggcatggatttgaggatctaaggcttaagacgatctggtgcggatattttgaaggcaatgaaaagtcgaagcgggtacaggaaaaatgcggatttcattcccatcatatggaaaaggacaaactctggcctctgatgaatgacattcggacagagtatattacttatataaccagagaagaatgggaagaacaaaaaagacaaggaggagtgacaggatgttagaactgccagaggtgatacatatttccagacagttaggcgaacaagtgaccggcaaaaaagtcatccgcgtactgccgcctacgaagaaccataagttctgctggtataacggcgctccggaagaatacgcagagatgatagaaggggcggctatagaaggcgcggaaggctttgggatatatgtggaaatcagattttccaatggctgtaaattgtgctttaatgatggagtaaatgtccgtctgatcaaaaccgaggcgctgcccaaagcctatcagctggcgatagccttcgaggatggggaggctcttgtatttaccgtggctatgtatggcggaatcatactccaccgaggagagtatgataatgaatactatcagaagagcagggaggcactgtcgccattttccggagaattccgtgcctattatgataaaaggatggctcaaagcaagcagacgctgagcgccaaggcattccttgctaccgagcagagattccccggaatcgggaacggagtgctccaggatatcctgctggaggcgggaatccatccgaagcgcaagatcaatacgcttgaagatacggatagagaaaagctattttcctgcaccttatccgtacttcaggagatgatcgaccagggaggaagagatacagagaaggatatcttcggcaatcctgggggatataagacgaggctgtcgaagaatacttataagtccggctgtccgcattgcgggggagaaattgtaaaggcgtcatatctgggagggtctgtctatttttgcccgaagtgccagccccttatgatcatataaactcataataaggttgagcgtttctaccagctgccgtaaatagttgattatgatccctgcaggattgtaattggctatttacggcagattttattttaaggaggagaaatggaatacaacaaattttaatgttttgaatttctggttttatggcacactaatctgtacaagcatttcaaatttgtatataataagcacggaggaagtatgatggaaataagggaaggatatatgcctttcatggggtatcagacatattaccgcatggtaggaacgcagacggggaataagaagccgctgattctgcttcatggaggtccaggctcgacccataattattttgaggttctggatcggctggcagaggaagatggccgccaactggtgatgtatgaccagatcggatgcggggagtcatatgtagaggacaggccggatctgtggaatgcagaagtctggatacgggaactggaagaattgagaagccatttgggcctttcccaggcacatctgctgggacaatcctggggtgggatgcttctgctggagtatctatgcaatcatgagccggaaggaattaaaagcatcattctttccagtacgctgccggcatcctggatgtggggccaggagcagatgagaatggtcagatacctgccgcaggaaatgcaggacgccattgaaaaggcaacggcatccggagactataatgatcccgcatatgttgaggcagaggcagaatatatgcgccgccatgcggcggaaacgcccaaggaggatgcgccggattgtctgaggcgtccggtcaggaaaggattagaggcttatatcaccgggtgggggcccaatgaatttacgcctcttgggacattgaaagattatgacgtgacgggacagttaagggatatcaaggcgccagcgctgattgtaagcggcggggatgatctttgcacgccatacattgccaagtatatgtatgacagaatccctgaatccagatgggagttgttccgcacttgccgtcatatgtgctttgtagaagaaaatgagcagtacatcaagctgttgaaagattggctgaatgccaatgacgaatgagaaaatagttagaaaaaggttagggaatgagactatggaaagaagaaaaggctttattgccgcatttatggcggggcttttgtggggggcgtcaagcccgatcgcccagtttttatttgagagcaaaggggtcgtatcagaatggctggtgccttaccgcctggtaatggcaggcatcctgctgcttttgtatgcagtcataattaagaagcagaatccggttgagatatggaaagacagaaatgaggcgatccgccagatcgcgttttctgttctgggaatgatgggcatgcagtacacgttttttgcggccgtccaggagacaaacgcaggtacggcaaccatcttccagtatctgaatccggcaatgctgatcttatatttcgcggtgatatacagagtcgcgccgaaggcaaaggagatcatcgcggttttatgctctgtatcgggaattttcctggtggcgactcatggcaatatccacgcgatgtccatctcgccgaagggaatcatcatagggcttctggtggcacttaccacttgcttctatggcgtgattcccggcccgcttcttaagaagcatccggcggagatggtgtgcgcctgggcaatggtgattggcggtgcggtcttaatggtcgtgaccaggccgtggaggatgacggtccagattgactggcaggtagcggcagcattcctgtccatcgtaatccttggaaccatcttcccattctgtttctacctggcagccctaaagagcataggctcggtctacgcgggcctgctatcaagcgtagagccggtagccgcgacggtgctggcagccctcttccttgggactaccttccaggccattgatgtggtgggattcgtgctggtactgtccaccatgtttatcttgaattataagaatacataaggaattataatacattccaaggatttggcttgccctgatctaccaaaagacagctttccagggaatgctttaccatatcgctgatcgcctgatcggtatagaaggccatgtggggagtcacgataacattggggaatccccggaggatgtagaggtcgcgtttgtccaggatgtcggacttccggtcaaaatagtacatgccgaattcgttttcgattacatccaggcctgcagcgcctattttgccagattcgatattttcgatcagcgccttggtatcaatcaggcctcccctggcggtgttgatcagaaccacttgatctttcatctgcgagatggaagattcattgatcatatggaaattgtcatcggtcaggggcatatgaagcgtgatcaggtcagattgggcatacagagtatccagatccacataagtggcgcaggcctttgcttcttcattttcatgtaagtcataggcaaggatgcggcagccaaatcccgtaagattacgaatgacagaacgtccgattcttccggtgccaactacgcctaccgtaaggttgggcaattcccggccctggattccctgtagggagaaatcattgagttcggccctctgcatgatgcgtttcattttccgtaaggacatcagcataagcatcaaggtgtagtctgccacgcagttgggagaataggtggcgttgccaacctgcattccaagttctcttgccttatccagatcgatatgatcatagccgacggtgcgggtagagatcatgcggacgcctaagtcatggaatctctggaccagcatggcgtcaaccttggtggtgataatactgatatattcatagccttttgcaaggctggcattttcaagagtcggggcgtcggggctggtacccagttcgatgccgtactcattgctgaaatgggtaaaccattcggcctcgtcaaattctctgtaactatacacaaatactttcataacggttgctccttttatcatatatttcttagggacgggcatatcgatacgccgatccacaacgctattatagcaccaaataagaaaagcgcgaaaataaattgactttcaattcctacagttgtaagatgtatacaaatatgtatctgagtataagtgttctaaggaggtatccatgaaacgtaaaaagattatagggacaatggccgcaatactgatcctgctgatcgtaggagccgtggcagtcgtgctggtaagaaggccctttgatgcgggaaagccagatgagttgctggctgattattttgcatgtattgaaaaaggcgcttatgacaagatgtatggcatgctggatgaagagagcaaggccaatatctctaaaaaagattttgttacccggaatcaaaaaatatacgaaggcattgaagcaaagaatgtgaagatcagcgtaaaggatgccaagaagacggatggaggggagaaggtatcctaccttacatccatggacagcgtggcaggaaagatcgagtttgaaaatcaggcgatgtgtaccagagactcctattttgatgagttcaaactctcctgggatgacagcctgatcttcccggatatgaaggatacggataaagtgtccgtatccaccagccaggccgtcagaggccagatactggatcgtaatggcaatatgctggcaggtcctggtacagcgccgtccgtcgggctggtgccaggaaagatgtccgagaacaaagaagcggatatcgcccagctggccggcctcctgggaatgacagaagaggagattaacagccggttatcagcagcatgggttacgcctgactctttcgtgccattaaaaaccctgaacagccagcaaagccaggaattgacggaacagcttctgacgattgccggggttctgatcaatgatacggaagtaaggacctatcctctgggagaaaaggcagcacatctgatcggctacgtgcagagcgtgacggcagaggatctggaagaacataaaggagaaggctataccagttcaagcgtgattggcaagagcgggatcgaaggactgtatgagaaggaactcaaaggcgagaacggcgtcaagatctctattatgacggaggatggcgtggaaaagaacgtagttgcatccgtggataagcaggatggagagaatatccggctgaccattgattcggatctgcaagggctcgtctatgaccagttcagggaagataagagctgctcggtggccatgaacccgtttaccggagaagtgcttgcactggtcagcacgcctgcttatgatgacaatgaatttattcttggcatgtcaggcgagcgttgggatcaactgaacaatgatgagaataagcctctgtataaccggtttcggcaggtatggtgtccaggatcttccttcaagccgatcacggcgggaattggccttaccactggaaccatcaatccggatgaggactatggaagcgaggggcttagctggcagaaggatgagagttggggggattaccatgtaacgacgcttcatgagtattctcctgtgaatctggaaaacgcgctgatttattcagacaacatctatttcgccaaagcggccttaaatatcggcgcggacaatctgatgaagtcgctgaaactgctgggatttggtcaggaactgccctttgagatcaagatgtcccaatcccagtacgccaatgacggggggaccatcgattcagagatacagctggcggacagcggctacgggcagggacagattcttatcaatccactgcatcttgccaccttatatacttccatcctcaatgacggcaatgtgatccggccttatctcacctacagcgagacgccaaagagcgaagtatggatcgcccaggcgttttcatccgatgcggcctccagagtgaagactgcgcttgaaaaagtggtcaataccccggaaggaaccgggtatggggcacaccgggaagatatcgcattggcgggcaagacgggaactgccgagatcaaggcagaccagaacgatacgacgggcacggagcttggatggttcggcgtatttacagaagatgctgccgcacagaagccagttcttctgatgagcatggtggaggatgtaaaggaccggggcggaagcggctatgtagtggataaaagcgcggccgtcctgcagggatatcttccataataaatatttatttatgaagtaggacgaaactccggaacatatactgtcaataaaggcatatgttctggagtttttcatatgaaggaagagaaaaaaagaaaatggaagaaccgaagcgttctggcattggtgctgacggtggccctggcagggtcgtacaaatatatatccggatatgtaacggtctccagcaatgtaaacggaagagaattgcccatctattcggtggagacaaaggagaagaaggtagccctttcattcgatgcggcctggggcaatgatgatacgcagaagattctggaaatattgaaaaagcatggactccacgtgaccttcttcatgaccggaggctgggtggaaaagtatccggaggatgtaaaggcaattcaggcagcaggccatgatcttggaaaccatagcgagaatcataagaacatggcgcagttatccacggaggaacaaaagacagaaatcatgacggtccatgaaaaggtaaagcagctgaccggagtagatatgcagctgttccgcccgccttatggagaatataatgacaatctgatcctgacggcaaagggctgtggatattttccagtagaatggtcggttgacagtttggactggaaggattatggtgtagacagcatccttgatatggtacttaagaacaaggaattaaggaacggggctatcatcctgtgccataacggcgcaaaatacactccggacgcgttagagcagctgattaccggacttgaagacaagggatatcagatcgttccgatatccgaactgatctataaggatcattaccatatggatgtgacgggacgacagatcaaagactagtgtacggtatgcccgggcatacgggaaggagaaacgatacatggagtatatgactatcatagcaatgatcctgtttggtatcgcgtatggctgccttagggaacgggcagggagacgggcactggccctaaaggcccttgctacttccatggcggttaccgcaggcctatacggcgcagtgcaaagtcaggataccgctggatggatgattgtggctgggcttgtactatgcatgattgccgatgtggtgctggaaattaggatggtgggaggaatcggcatattcggggcagggcacctgtgctttatcgccgctttctggctcatgtctcctcccaccccaggcacgctgctgcttttcctggccatatacgtcgctgccataggaatgttccggcatgaaatcgcagggcttggcgggcttaaggttccggcgttcctctacatggcggttctaggattcatggtatcgatggctgtgacgtcgggctggcacataggcggcagcgagggcatgcttcttgcggcaggggcctgcctgttcctggcatcggactgtatgatcgcgtggcgcacggtgaaggatatccggcagaatgcttacggagccatcctgcttatcctttattacgcggccgtatatctgattggaagcgcatcctggatctgattgtggattatatgcaaaaaaattgatggtcagcgactgaatttctctgattattgaaaatgaactatgttataatagaactgcgctgcctggatagaaggtagctgcatgacagtatatgatagacaaatattggtacaatattacatgataggaggattatagagacatgcagagtacaagaaaggtaactgaagacattaggtgggtaggatgcaacgacagaaggcttgctctttttgagaacttgttcccgataccaagaggcgtatcctataattcttatctgattatggatgagaagattactctgatggacacggttgacgcatccgtaacccatcaatttattgagaatctggattacgcgctggagggcagaagcatagactacctcgtgatccagcatatggagccggaccactgtgccaacatcgaggaactgatgcgcagatatccgaatatgcaggtggttgcaaaccagaagacaatgcagatgatcggccagttctttgatatcagcacggagggaagaacggttcttgtgaaagaaggggacgagcttaataccggaagccatacgctgcgatttttgatggcgcctatggttcactggccggaagtcatggtgacttatgatgaaaaggacaaggtattattttcagcagatgcgtttggaacgttcggcgcattgaacgggaatatatttaatgacgagatagattttgaaaaagactggcttttggatgccagaagatactatgcgaatattgttggaaaatatggaatgcaggttcaggcgctgcttaagaaagcggctgcgctggatatccggatgatctgctcccttcacgggccgatctggaggaccgatctttcctactttattgacaagtatgacaagtggagcaagtatgagccggaagatcaggctgtggcgatcatttatgggtcaatctacgggaatacagagcaggcagtcaatgcgctggcaatgcgcctggctgaaaaaggcgttaagaatatctcggtttatgacgtatccactgtccatgtctccgacctgatcgcggagatattccgctgcagccatcttgtgctggcatgctctacctataacggcggaatctatcctccaatggagaacctgcttgcggatatgaaggccctgtctgtaaagaaacgtacggtagcggtgatggataacgggacttgggcgccttcggctggaaagcagatgattaagatgctggaagaaatgaaagatatgaccattctggacatgcagctgtcgatcaagtctactctgaaacaggaacgggcggaggaactggcagcattcgcgcagcagatcgtagatgccatgtagcgggcagatgacagaagagaaagaaggatggctatggataacagagtatcggtaatcagcattattataaaagaagaggaatccatcggggcagtcaatgaactgctccatgaattccgtgagtatatcgtgggacgtatgggaattccctatagggaccgcggcgtctccattatcagcgtcgtgctggacgcgccaggcgatgccaccagttccctgtccgggaagctgggcatgctggaaggcgtaagcgcaaagacgctgactgcgaaactatagccgatggatgccgctttgcagttcctcagcccatttctgaaggttataggttctgcctccgaagagtttgagaataacgccggtgggatgattctcattggcaaatgcattggcttcgtccgtatccacatgcatggcaagcgcaaattggggactgacgcggacgatgacatccgcgaaaatgagggagcgctcataactttccatgatcacgaacacctcgtcattgtcttttacattcatctggacagcctgtacaggcgtcatatggatgtgccttttggccacgatgacgccgtgatccagctcgatgctgcccttcgggccgatcaaagtacagccaggcgtgtctttcgtatctccggactggcgtatgattcccggaaccccaagcttgcggctatccgtcatagatatctccagctgggtctccttgcgaaaaggccccagtatggcaacattctcaaacgatccttttggcccccggacgctcagccgctccttggcaacgaactgcccaggctggcttaagtcggctttgtaggtcagttcgctgccctcgccgaacagtgcttcaaagtcattgcggcacatatggatatgccgcgcgctggtttcaattggtattgcaacgcccatatatgacaactcctttcattgcgcgatcctagtattcctattttagcaaagagcgcgggctttttcaatcgaaaggctttcctttcttcctcaaaagtcatataatgggaacatggaaactattaggcgagtatagattgcaaataaggaggatgcgattatgcgtgatatctgggaaaatattaaggatttctttacaagggactggacgatgacggagaaggtgctggtaattctgtgctgcatactgcttggcatggtgaagggattcttactggcccccatcaagaaaggcatcagctgcggcaacaatagcggaaatacttataaccagctggacgatcagtactggctggatgacgaagaataaggcaaattctacaggaatgtttggcattttgtcacgttgacaaagtgcctttttctatctataatttaatattgtaaaacaatggcgttttcatcatggcatgagaacgcccatttttatatgcgaaagtaactaataaaggtaggcaggttctgaaaaagatacatatatcaggaggttgaggcaatgaattattatacgagagcagatattttaagaatagtagaggaagaagatgtgggcttcatacgccttcagtttaccgatatcttcggagtcatgaagaacgtcgcgatcactgccagccagctggaaaaggcgctggatcatcagattatgtttgacggggcttcaatcgaaggctttgcgaggattgaagagtctgacatgtatctatatccggatcttgatacctttgaaatatttccatggaggcctcagcaagggaaggtagcccgattgatctgtgatgtatataagccggatggaaccatctttcaaagcgatcccagatatgtgctgaaaaaggtaatgtctcaggcaaagtcaatgggactcgaattcgatgtggggccggaatgtgaattcttcctgttccatacggatgacgatggactgccaacgactgtgacccatgaaagcgcaggctatttcgatctcgggcctctggacttaggagagaatgcgcggcgtgatatggtgctgacactggaggatatgggatatgagatcgaggcatctcatcatgaatccgcgcctgcgcagcacgagatcgatctccactatgacgaggcattggcttcagcggacagtattatgacttttaagcttgtcgtaaagaccattgccaagcgccatggactgcatgcaacatttatgccgaagccaaagtccggtataaatggctcaggaatgcatattaatatgtctatgagaaaagacggcatcaacatatttcatgattcaaaagatcctgcaggattaagcaaggaagcctattggttcattggcggacttatgaagcatatgaaggccatctgctttatcaccaatccggtggtcaattcttataaacgtctggttccaggctatgaggctccagtatacattgcctggtcagccaggaacaggacgccgctgatccggatccccgataccaggggagatgccgtaagaatcgaactcagaagccctgacccatcggccaatccttatctggcactggcagtttgcctggcggcaggacttgagggaattcaaaatgagatcatgccgcccaagagcgttgactgcaacatctatgagatgtccgaggaagagaggaaggcttccgggatagagatgcttccgggaagccttctggaagcggccagggaatttgagaaggatgcatttatacaaagcgtactgggagaagatctgtctaagaaatatatcgaggcgaagacaagagaatatgcagattaccgcgcccaggtcacggattgggagataagcagatacctgcaccgcctgtagacattcctgctggaacacgtagacaaggagcaaaacaggaggtatcagcttggtaggtattattgtcgtatttcccaataagggcaatgcagccaatattcggaacctgctggttcgcggcggcatggatgtgacaggagcatgtaccacaggcgcccaggcactgaactatgcggatgccttggatgaaggaatcgtggtatgcggttataagttaaaagatatgatgtatacggaactgcgggaatatcttccggagcaattcgagatgcttctgatcgcatctgcggacaaatggagcacaggcctgatcgacggcatcgtggggctgtcaatgcctgttaaggcatatgatctgatgaatacgatggatatgatgcttcgcaatatggggcaaaggagaagaaagcgaaggctggatcgaaaaaccagagactccaggcagcaggaagtgatcagtcaggcgaaagaactgctaatggcgcgcaacaacatgtcggaagccgaggcccacagatatctgcaaaagagtagtatggacagcgggacgaatatggtagagacggcccaaatggtgctaagcatcatggccgaataagaagagtagtcataaaggagagtattggtatgagatttacaaaaatgcatggtttggggaacgattatgtctatgtgaattgtttcaaagagaaggtggaacatccatccgaggtagccaggttcgtaagcgacagacactttgggattggctcggatgggttgatcatgatcaatccatccaaagtagcggattttgagatggagatgtataatgcggatggatccaggggggagatgtgcggcaacggcatccgctgcgtggcgaagtatgtgtatgattatgggcttacggataagaccagcatatctgtggagaccctgggaggcatcaaatatctggatcttaccattaaggatggcaaggtcgctcttgtaaaagtagatatgggaaaaccagaacttaagccggagagaattcctatcgtatcagatgaagagcgcgtggtgaacgagccgatcatcgtgggaggcatggaataccggatgaccggggtttccatgggcaatccccatgtagtcgtctatgtgaaggatcttgaaggagtgaaaatcgaacatgtaggccccaaattcgagaatcatgagaggttcccaaaaagagtcaatacggagtttgccaaggttctggaccgcaagaccgtagagatgcgagtgtgggagagaggctccggcgagactctggcctgtggaaccggcgcctgcgcagtggcggtagccagcatattaaacgggatgacggaagaccaggttaccgtgaaactgctgggcggtgatctcttgatcgagtgggatcaggaggctgacagagtctatatgaccgggcccgctaccgttgtatacgacggggagattacaatataaacagaaaacattacaaaaaaggagacgggaagatgtttaaagtaaatgaagattacttgaagttaccaggaagttacctcttttccacgattggcaaaaaagtggcggcttttcaggaagccaatccaaaacaggatattatcaggcttggaatcggcgatgtgactcagccgctggcgccggcgatcattgacgccctccacggcgcggtagatgaaatggcccatgcagagacctttcatggatatgccccggacttgggatacgagttcctaagaagcgccatggcaaagaatgattaccaggacaaaggatgtgatataaaggccgacgagatattcatctcagacggagcaaagtgcgattccggaaatatccaggaaatattcgcgaaggataataagattgccgtatgcgacccagtctatcccgtctatgtagatacgaacgtaatggccgggcgtaccggggtctatgaccagaagtcggagacatggagcgatgtgatctacatgccttgtacgaaagagaccggatttgcgccccagctgccgaaagaaacgccggatatcatctatctgtgtttcccgaataaccctaccggatctactattaccaagtctcagttgcaggaatgggtggactatgccaataaggcgggcgcggtcatcatctatgacgcagcctatgaagcatacattagtgaagcggacgtgccgcacaccatctatgagtgcgaaggcgcaagaacctgcgcgatcgagcttcgaagtttctccaaaaatgccggatttacaggcgtaaggcttggcgccaccgtgattcccaaggatctgaaatgtggagacgtgatgctgcattccctgtgggcgaggcggcacgggaccaagtataacggagccccctatattgtccagaaggccggggaggcagtgtattccgaagctggaaaggcacagttaaaagagcaggttgcctattatatgaagaatgcctccgtcatctacgaagggctgaaggaggcaggctacaacgtgtcaggaggcgtgaacgcgccgtatatctggctggagacgccaaaagggatgacttcctgggaattctttgactatctgctggaaaaggccaatgtggtgggaacgcccggttcaggattcgggccaagcggcgagggatatttccgtctcactgcctttggatcttatgaaaatacagtccgtgcgattgagcggatcaagaagatatagcgaggatgaaaaaagggatgccagcatgtatcgcatgcgggcatcccttttttacccttttatggaaggttctcttcgatatatttgtagtaatctgtgttcaagactttctccgaaacggtaaaccggttataaatatcggcggacatggaatccaggtactcctgggatacggattcgtccgcaagaggcgtggcagagccggtggaagcattgtagatgcatttgtccgatataaagctcctgtcagggaaacagaccagcgaaggggcgtctgagaggatatcctgtccaatcataagccgggaatcataatcgagccccaaaagattggagatggtaggaaggatatccacgtcgtaacagtacttgtctactttcacgggctcctccatgctgccggaccagatgatcaagtcattctggtaccattctatagatggctccagttcatgtcctgccaactcatcacaaactggcttgtcattgtaggggatatggtctgctcccaatacgatcacggtatgatcggcgattccacgctcttccagttccgagaccagtaatttcatccccttttccagttccagctggcaggccagatagcctttggtggtctccgaataaggaagatcagccactgcgtcatagttgcggtacgccatctggttgccgcttacatcatacagcatatggccgctgaccgtcatgtagtaggtgtggaatggctcgctgtccatataatcgggaatgctctgctccatgagctgaagatccgactggggccagtaatcctttccgctgtctgttttctccggctggaaccagtttccggtgccatgccagtcatagcccatattcggatgggagagatcccggccatagtaggtataactgttattgtggtagccattgaccgtgtagccaagcctctttaactgctgtccaagagtaaagcgcatatctttgccatgctctcctgcgaccttcatagatacgatgccatccgtaggaagcagtcccgtcagattggcatactccccgtcggaagtactggcataccagccgggcgtataataatgctcgaatacaaatccctcattcttaagccggtacaaagtgggcgtacgctcctcatcaatcacgaaccgggagaatccctccgcggtgatgaagatgacgttatatcccttgaacatcccggtatactcattcttggaagtgccgggacgttccttaaaatactgcgtcagctggcgaacgtcgtcatccggggcggcattaaaatcgcttcaaaatcaatgttcaggacattgggcgaggtatccacggaagcctttgtcacggaggcttcaccaaaggaagccatatccgccagctggagcgtcttctctggcttgccggcaatggcatagattccatccagccgagtcatggaaagcacgccaaaatgctctaccgtcatatcagtagacacgttatgataatagatgtcataaggactgtaaggcgcctggctgcccatattcaacaggagaaatgcgatcaggaagcattcgcaggcggcgcccaggcaggcaaggccgcttcgaagcctgacttttggaaatgtaaggcgtctcttacgataaccgatgataagcaagggaatgggagccaataagagcagaatccccagaaggctgcccagcacgttcttggatatgacttccatgaagtcaaaggcctgatccgccacgcccagcatactgaaaagggcgaggaacttctggaagaccgcatggtaaaccagctgggcgcagaagaatacacacagaaggactgttgcggacaggcttagaatgtaattcgtcccggggcttaagcggctgcacgcaaaacccagaataagggcgatggacaaagagaataatacaatgtacacaatatccttattaagggaatggaacataactacatggaacgccagttccagatataggaccaatgccataaaatagcagaaaggcataaaggcggatattctatctttcatagcgcaaaacctcgatctatagtgatgtctatattctaccacaaatcgacatcttccgacataggaatatatttaagggatagattttagcacgcaaaaaaaggaactgcattttcatgcaattccttttttaagccttggccttaagtcggagtgacaagatttgaacttgcgacctctacgtcccgaacgtagcgctctaccaaactgagccacactccggaaatataaccggacatcttgtcctgcaagatacccggcgcccctgccaaggaactacggatagaggactcgaacctctactaacagagtcagagtctgctgtgctgccattacaccaatccgcaatgttttttccagcgaacatgttatattataccaaatatttatcaaaaatcaaccccttttttcaactttttttattttattttttatcctcaagagtatagccccgtttgatctgatttatgctgtctataagtacgtttttttgtagaaattattgattaggcataaaaagtggggcgtgatattctattaacgaaattatggaaaagagggaaatcatatgaaaaaaacactattaacgtctttattgtgcgtagcaatggccgtcacattgacggcaggctgcggcagcaaggccgaatccaaggactcaaaaaagcctgagaaaaagagcagcgtcgagacaacggtggatgtagaatctgccaccgcttcgcaggtagaggaatttttgagcgattctgatgataatacgatgcttgtcgatgcacgtccgcaggaggcttattcaggctgggcgctggagggagcggcaaatggcggacatttgaaggacgcggctctattttcagcccgctggcttgactgcgagtattctgagtctgcctcccgcgaggcttatcttgaaagagcgctcaaggatcaggatatcacagaagataaggaagtgatcgtttacgattataccggagaacaggcacccgctgtggctggctatctaaaggagcagggaatcgaaaatgtatccgtattcaaggcaaatgaactgattgatgcaggaacggatcttgaatcctacgaaaactatgacagattcatcccgacggaaatcgttaagagcatctccgatgtaaagacgggaaaagaagagactctgagcgatgaggcaaaagcggtagttggcgacgacgtcagcaatgtcgtgctggttgacgtaagctggggaaatgcgaagcagtctacatatttctcagttggccatgtgccgggagcagtccatattaatacggactcctatgaaaggccgcgcgtatatgtgccggagaagagatctgaatatgcaaaagaatggcgtctgatctctctggaagaattccgcgacgaagtctgcacgcagtacggaatcacgaaggattccacggtaatcttaacaggaacagtaacggatccccagggacgtcttggatttatgctgagatcgctgggggttaaggtctatgctatgagcggaagcctgacggtttggagttataatggctatgatctggatacaaaagagagtactctggtaacgccggaaccggcagacagttttggagcggatacgatccagaatccggatgagatactttggatggatgacatcaaggctattttaaatggagaggtggaaggacaggttgtagacaaccgcggaaaagcggaatggaacggcaaagaaaccggatatagctatcatgatctggcaggacgtatcgatggatccatctggtgcgcgcaaggctctgaaaaagaaggagaattttttgagaacgtagaccatacgccgagaacccagagcgagctgaaatcctacctggagagcaatggccttgatgtttctaagacgttggcgttcttctgcggtgacagctggggcgctgctaagatagcctactggtgccagtccgctgatcttaatacggtaaaggaatggggcaatggctggatcccatggtcaaatgaaggaaacgaattcattgatcataatggaaataaagtacactatgacaaatatcaggatgcgcttctggataaagatggaaaggatgtaagcgacgggacgaacattcttgacgatgcaacagaagaataatatgacaatgtgctcttgtttttacaggagcacatttgctgatataaaaaggtgggaaagaacagatggacaagaaacgaagaaatagatttttaattgccctggcctgtatggctctgatgatcggcgtgttcgcgctgattaccgtagtcgtaacgtcaacaacgatggcggaagcgcggacacaagcaaatgaagaaacacagacagacggcggcgacaaggaagaagcatcctccgattcttcagagaaaaaggctgcaaaaaaactgattgacaaaaccgtttcaagggaaaaggtaaagaaaaacgtaggcgaatgggagaagttcgaaatgagcagcgatggatgcgagcggggagtttacgccggaaaattctactataaagattttaccattttttccagaacctatgataaaggaaagaccttccatatcgtatctgtaaattaatgaaagaaagagagaaaatagcatgaataaattattagggaagattggagtcagaggcaagcttgctgaaaattttggcgcgatcgttatcctggcgctcagtggctccgtaatcttcggacttcctttcttccgattcgactattatgacgcatatatcacgacgtaccatctgacgaacacgcagatgggcgtatttggaacggtaatcggagcctttggcatcgtatcttatctattcggcggagtcgtcgcagatggcatgtccgttagaaaaataatcgtaatatcgctgttcggcacagggatcggaggcctccttcaccttctgccgctgggatttggaggccttctgtgcatctatgcactttggggagtctccacgacatttgctttctggccagcctgtgtgaaagcagtgcgggtaatgtccgacaaggacagccaggggaaagcctatgggttctttgaaggaacgcagaatattggcggcgccgtcgtcgcgctgattgcagtcgccttttttaactggggcgcgggaaggatggagaatgaggtactggcaatgaagtatgtcatcctgttctatgcatttgtaaatatcgcaatgggcgtatttgcattttttgcggtaaaggatgagaagatgatactaaatgcggaccgggtatcgttcaagggacttgcaaaagtactgaagaatcctgccgtatggattatctgcctggtatcgttctgcaaccacgtgttctgtttgtcaatttattactatattccatatgtgacggatatccttggagccagcgtcgcgttcggagcgatgctcggcgtcttccgtaagtttggctccatcagcggcaacattgtgggcggatatctggcagataaattcggcacagcgcgcttgatgctgctggcttttatcgtaatgttcgcaggccagggcatgatgcttatgatgccggcaaagcattccagcgtcgtggttgtggcagtcttgtttgtcacgatcctcatttttttccatatgaattatgcaatggcgtggactatgatgagcgagggcgcggtacctgtggagtattccggcactgcggcaggactgatctgcacggctggcgcgattccggagacgtttgtgtccatccttgccgggaatatgatcgatcatcatccgggcgtgacaggattccgttacttcttctatttcctgacggcagtgatcggggcaggatttgtcctgatcctaatctggcggaaatatctgaagcacgccaaaattgacaagtctaaatttgacgacaaggctatggaagacctgaagcaatatgtataggcattgagagcggtatttctctgtatagacttcccaaaagcagcgcagactaagaataatagtatgcgtggacgcggcatattgcgcccatggcgggaggtataggaaagtgagcgatagaatcatagtaatcggggcgaaccatgcaggtacggcagcgttgaacaccattctggacaattatacggataaggatgtgactgcgtttgacgccaattccaatatcagttttctgggatgcggcatggcattgtggatcgggcggcagatcagcgggccggaaggcctgttctactcggacaaggagacactggaggaaaaaggggcgaacgtgtacctggaaacaaaggtgtcccggatcgattttgagaaaaagacggtatacgcaatggataaggaaggcaaggagatagaggcgaattatgataagctgatccttgccaccggttctcttcccatccagccaaaggtgaagggaatggaactaaagaatgtccagttcgtcaaactgtaccagaatgcggcggatgtaattgagaaactggaagatccgtccatccaaagagtcacgattatcggagccggctatatcggcgtggaactggcagaggcgtttgcaagaaccgggcgcaagaccaccctggtggactgtgcggatacctgcctttctgcctattacgatccgcaattctgtgagatcatggaagaaaacttaagagaaaacggcgtaacaacagcatttggagagatggtccaggaaatacaaggccagggacgcgtggagcgggtagtgacggacaagaattcttatgatacggacatggccgttttttgcatcggatttcgtcccaatacccaatatgtggatggtagcctggaacttttccgtaatggggcattcctggtagatctgcatcagcagaccagcaggccggaagtatatgccatcggagactgcgcgacggtgttcaacaatgcaacccagagaacggactacattgcccttgcgaccaatgccgtgcgctccggcatcatcgctgcccacaatgcgtgcggaacaccacttgcatcagcaggggtgcagggctccaacgcgatctgcatttgggggcttaatatggtgagcacgggaatatctttgaaaagggcgctggaacttggctatgaggcggctgcggccgactatgaagactggcagaaggcagggttcatagaaagcggcaacgagaaggtgcggatccggatcgtctatgacaagaagacgcggatcatcctgggcgcccagatgtgctcgaaatatgatatttccatgggaatccatatgttctcccttgcaatacaggaacaggttacgattgacaagttaaaacttctggatctgttcttcctgcctcattttaatcagccatataattatattacgatggcggcgctgaaggcagaatagtggataagcaaaatttttgaactacagcacttcccgttataaaatagaatttgtataattttatggcggggagtatggggttcatacaattgataaagggaatctattttgacatggaaaaacaatgataaggttaaaaaaagtgataaaagcagaaatgataagaaaaattccgaaaaatcaaattgacaaacgataattatgatgctaatatcaaattaaacctacagatgtacatctattttttttaccattgctgatattatcagagataatatcaaaaggaataatagtaataatgacaagaaaggaagtaagagagatgaatggcagagaacgcgtgatagcggcgattaggaaagaaccattaacggaaattccgtcaagtttttcacttcatttcccagaaggatgtgaaaatggagaagaaagcgtgaaagcgcatctggaattttttgaaaagacaggcacggatatttacaagataatgaacgagaatcttatgcctgcatgtgacggcgtaaggtgcggggatgattggaaattgatacccaagttttcccggaacgatgcgtggctaacaaagcagatcgatcttaccaagagaatactggaccggtgcgagcccggacattttaccatgggaacgctgcacggagtcgtggcatccagccttcatttgattgagaaaagatacggttatgacggagggcgtctggcacagccagagcatctcaggcagaataaggtggctgtggcggatgtatacaagcggatcgcggatatcttatgcgtgctggcggaggaatacataaaggctggattggattcggtttactacgcggctttaggcggagaataccgctactatacggatgaagaatttgagacatttatagcgccgctggacaagcaggttatgacggcgataagagagagcggcggctactgcgtgttacatatatgcaaggacaggctgaacatgcgtcggtatcaaagttacaacgactacgcggatattgtgaactggggaatctacgaagcgccattctctcttgaagaaggaaagaaattgtttcctgggacagctatcatgggcgggcttgcgaatagaagcggcgtgctggtagagggaacgaaggaagagatagaagacagggtaaggcagatcatagaagagaatggtaagacaggattcatcttaggagcagactgtaccattcctacggagattgaatactggagggtaagagcagcggcagaggcagccaggaaataaggaggaacgtgtatgtcatacagattagcagcggatgtgggcggaacctttacggatattgttttattaaatgatgataccggcgtctacgagacgaccaaggtgctgacgactcctgaggcgctggaaaaaggaatactaaaaggctttgatgaattggcgggagataaatatgatcagatagccagtattgtccatggaactacttctggactgaattccgtgatcgaacgaaggggagctcactgcgcgctcgtgacgacaaaaggattccgcgacgtgtatgagattgccagagccaaccgtccggagatttataatatccactatcacaagccagagccactgattccgagaaaagatatatatgagatcgatgagcgggttgcttttgatggaaccattgaaaaaaaagtcacaaaagaaatgatgcaggaagtgacggaggctttaaagggaaagtatgattccatagccgtatgcctgatcaacagttatgcaaatacggagaatgaaaaggaagtatgccggattctggaagaggaactggaagaagggacgatcatcactgcgtcccatgagattgcgaaagaatccagggaatacgaaagagtgagcacttccgtactgaatgcatatgtagccccaagcacaagaaggcatgtatttgcactgtcggaagaacttgaaaaaagaggctttaccggcacgctttatatgatgcagtcaagcggtggcgttatacgggcagagatggcatcctctaccgccgtatatacgctgatgtccggtccggtcggcggagcaatcggtgccagcgtgatcaaccgggataatttgatcggatttgacataggcggtacgagttttgacgtgagcatcatcgtgaataaccggatggagaccacggtagaggctgagatcgagggattcccggtactggcgccaaccgtcaatgtattcagcattggcgcgggaggcggaagcatcgcatggaatgaagcaggggggatgcgtgtaggcccgcaaagcgcgggcgcgatgccaggcccggtatgttatggaagaggcggcgataagccagcacttacggatgccaacctggtactggggcatatgtccgctaagcattttctgggcggcaggatggagatggatacgcagaagactctagacgtatttgaagagtacggaaggcagttcggcctggatgcggtcactgccgcggaaggcgtctgcgagatcgccaaccacaagatggcggatgccatccgggaacttacggtaaagcggggaatcgatccaaggaacttctcgattctcgcgtttggcggagcaggcccaatgcatgcggcgctgatcgcggagatgctggatattaaggaagtcatcgtaccggctaatccgggagtgttttccgcgtggggcatgctgcatgcggacatccggcatgataccggccgaaccagggtatgcctgctgtcttcgctgaatgaggaggaattccacaagaactttgccgaactgaagcaggaactggacgaagtactggaaaaagaaggaatcatagatgatgaaagaaaatatatctgtgctctggatatgcgttactttggccaggagtacaccatttctgtggatattccggacgagtccgtgtttgataaggatgaaatcgagaagtcttacagcgccatttatgagaggctatacggacaccattcatccgataatgtggtagaactggtaaattatcgcatgacagtgctggtacccgtgaacaaggctgcttcggggagccgtgccagcgatagccaggttgagcctattgagaagattcaaggctactttgacggcagaaaatatgagattgatgtctattcccgggaatgtcttgtaaccggaagcgagatctcaggtccggccatcgtggtcgaacttacgtccacgacgatcgttccgccgggatggaggctgacggtagatgaagccgatagcatgataatgaaaaggatgaacggaggtgcggcaaatgactgatagagtgaatccaatcgtggtagagattattcgaaatgcggtgaattctgccgcaagggaaatgaacagctgcctaattaagagcgcatttggcccgggcatctatgagatgaaagactgcagcgtcggaatcttcgacagggaggcccggctgttgggacagtcttctggactgcccatcttccttgggaatctggagatctgcattcagatcgtgacggataagatcggactggatggatatcagaaaggcgatgtgttcgtaatgaacgacccatatcttcaaggaactcacgctgctgatattaccgtgttttcaccgatattctatgaaggaaggctggaagggttctccgcggtccgcgcagcaatgcaggatatgggcggaaagaatcccatgggatgcgcggacagcacagaggtctatcaggagggattaaggataccgccggtcaggctatgcagcgcaggggcgatttgtgaagatgttatggaccttctcacgattaatagcagatatcatgcaatgatgagaggggacttaaatgcctgcatatccgcctgctacacaggagagaccagaatgggagaactgtttgggcgttacggtacagaaacagtccatcaggcggcactggagatattccggcagtccgagcagcttgacagacaggcggtggcggagataccagacggagaatactatgcggagggctgtctggacaatgatggaatcacgccagaagagcggccgcttaaggtaaaagtgacgatccggggagaagagatgacgattgatctaagcggaagcgccagaatgggcgtagggccgatcaactgcggagaagcacagacgatcgccgcatgccgtgtaggttataaagaggtgatcaatccggatagccaagtgtccggaggaacgttccgcaatctcaatgtaatcgtagagaaaggaagttttctggcggcagaagagccggcgccgtgcggctggtactttaccggactgggacttttgatcgacctgattatcaaagcactggctccggtcattcctaagcaggccgcggcagcccattacggagactcgaatgtcatcctgttcagtggctacgacagcatccgggaaaagcagtttgcgatctgcgaggccacggcaggaggctggggcgcgtatgacggggatgacggacagaatggcatgatcaatgtagtcaacggagatttgaagaactggggaattgagtttattgaaagcaaatatccactcagaatcctgtcttataaggtacgggaagattccgaaggcgcgggacagtttagaggcggccttgggctggaacgcacctatcgcgtagagacggatgcgcagtgcaatctgatgctctgggtggaacggtctaagacgacagcttgggggctcttgggaggacatgctgcacaggcgcctgatgtggtggtcaatccgggcactccggaagaaaagcattatctgaataccaatatgcttcctgtgaagaagggagatattataaggataagtacaggcggaggaggtggatacggagatcccaaagaaagaagccgggaagcaatcgcgtcagatattgagaatggatacctgacattggaacatgcccagaaattgtattgttatcagtaataggaggaaaatttatgaaaaagaatttaaagaaagcagtttccctgttgatcgtatttgctatgattatcagccttgctgcctgcgggaagtccggggataagaaggaaggtacccagaaggcagccagtgacgaggataagacgtttaccgccgcattgggcgtcatgccgtctaatttcgacccgacgaatcttgtaggggccggagacatgaatgcatccagaacctgttatgagccgctggtggaagaggtccgcggatcgacggaactggagccgtggctggcagaaagttatgaggttcccgatgcgaagacctatatctttaaactgcgggaaggcgtgaaatttgccgacggaacggatttgaacgcggaggcggtggtgtattcctataaccgcgccatggcttttgtaagttccatctccacgctggtacaggaaatagagagtgtggaagctacagatgagatgacggtaacgattaagttaaaaagcgataattcaggattcttatacaatgttgcaaagattggaatcatctctccaacttggtgcaaggagcatgaggaggatggagattgggcacaggcatattgcgcaagacattcctgtggaaccggcgcttatcagatctccggctttgaagaagaccagtactatactatggaaaaattcgacgactactggggcggatggaaagataatcagattgataagatccagacactgatcgtaaaagacaatgcaacacagattcagatgctcaattccggcgaagtagacaaacttcagattccaattactgagaatctggatattctagaggcaaatgagaatatcgacgttctgacagaacaatctctgcagacaaatatttttaccttcaatactaagaaggctccgttcgataacctgcaggtaaggcaggcggtgacgctggctatgagctatgaaggagtaaaagataatgtatataacggaaaggctacgattccaagcggatttatgccggcaaaatttgcggagcatgatgacagtattccggaacagtcacagaatcttgagaaggctaagaaattaatggaacagtccggcgtaggcgaatgcaaaatctcagttcacctttgcgagggaagtgacgaccaagtacagatggcacagatcctccaggctaatctggcagaaatcggcatcacgcttgaagtcaaagttatgccttggctctccatggtagaagagaattcttcaccagataccgccccggaaatgtcagcgcttaatatgggggcatttacaggcgactccgtgttcttcctgaaacagaatttccacagtatgtacagcgggcagccatacaactggagtttttatgagaacccggaatttgacgaggcgattgacaaggcaacggcaaccgtagatgaaaaagagaagaaggagtatctcaatacggcgcagaatattctcgtggatgactgtgcggcactttatatagcatccccggattctgtggaggcgatcaataacaaatatcagggatttaagattcatccgttggactactattattccatccgtttctatcaactgacaattggagaataagaatcgtccggaagattaagggggcaggttatggttaaatttttggcgaaaagaatattatctttgatattcgtcgtaatagggatcacgcttgtcgtgttcatagcgacacactgtcttccggctgatccggcgcgggcggctgcggggccgtccgcctccaaggaacaggtcgaagaaaaaagggtggaactgggactggaccggccgctgtatgtccaatatctggattatatgaaggggcttgcgcattttgatatgggaaaatcctacaaaagcaggcagccggtgacacaggagatttcttcaaggctggcagccacgatggaacttacagtcctgtctcttgtggtatttttcattattgcgctgctgatgggaagcattgcggcgctgaagaggaataagatcatcgaccatgtcatccggttcttttcggtgggaagcatggcagtaccgccttactggctggctcttctgctgcagtattttctgttctataaagcgcagctgctgccgtcaggctaccggcttccggcgggcgtgaccggcccggataccgtgaccggattctatctgctggacagcgctattcaaggggactgggccttgttcgcgctgtgcgcgaaacatttgctgctgccggtattgagcctggttatcgggtattgcggaatcacgacaaggatgatgcgcacacagcttttgcaggaactgcggcaggattatatccgcacagctagatccaaaggcctgcctgagcatacggtaataagacgccatgcaatgaaaaacgccatttcccccatattgactatgctggggatgcaggccggcggcatgatcggaggaaccgttttgatcgagaagatattcagctggccgggactgggctcctatgcgctggaggcgatcatgtcgatggaccttttagtgatcgccggaatcacgacggtgatggctgtcattttcatacttattaacctgattgttgatatttcctatgtactcatagatccgagagtgaggttatcatgatgaagacgataaaaaaatactttttccgggacattccatccaccataggaaccgtgatctctctgggaattcttctatttatgattataggcccctttgccacgaagtatgaccctcttacggtggatatgggcgcaaagcttgtgaagccgggaagcatacatatctttggaacagacgagatggggcgggatattttttccaggcttgcgtatggctcatggtattcaatggggacggcgctggcggtggttcttcttgcagccatagtgggaatcatcgtgggcggaatcgccggatatgtgggtggctggttcgataacctggttatgcggatatgcgacgtattcctgtctttcccgcaggtattcctggctatgatcatcgctgcagccatcggtgcagggatcggaccgacgatattcgcgctggcagtctcgtggtggccgaattatgccaggatggtgcgggggatggtaatcgtgatcaaagaaaaactttatgtagagtcggcgaaggcgataggaatgcatcctctgcgcattatcttcaccatcatcatcccgcagactatgtcaatggtaatcccccagattacgatgggaattggaaacgcgttgatcgcggcatccggattctcgtttatcggccttggagcgcagatgccgacgccggaatggggggcgatgatatcccagggcagcagattcatcttcaatgcgccatattatgttatcattccgggtatatttatttttcttgcagtgctgggattcagcctgcttggcgattcgctgcaggaggcaaccaacccggaacttaaaaatttgtaaacgttcgttaggagagcaattatggatatcagcagaaaatttgaagaagcaagaagcgtgatgaaaagttatgggaaggactgcatgatactggcgccttctacggatcttcgctacctgagcggatttcatgggatttccatggaacgcccgattttactgatattaacgctgaaaaaggcgtttttcgttctgccggagtttgagctggacaacctgagagaggaattgaaggctgccgttacctgcatttcgtggaaggaacaggaggacccctatgcaaaggcggcgcaggctttggaacaggagaatatttgccacgcggtttttggaaaccagatgcaggcggtgatgttctaccgcctgaaggaggcatttacaaactggcggtgggagccggcagggccgctgatggcaaaactccgctcaagaaaaaaggaagaagaataccaatgcctcaaaatggcccagagactgtctggcgaggcgcttttaagacttcttaaggaaggcctgtccggccggaccgaactggaggcggctgtaaggctcaatgagtatatgcgcgaagcggggctggaatgtatgggtacgccgctggtggcagccggggcgaacggcgcgcttgcacatcatggcgccgatgataccgttattcggagaggagatcctgtcatcattgattttggaggatgctgcaagggatactatgcggacattacccgaaccgtggcggtgggagacatatcggaagagtttgccaatgtcttccggattgtacgaaaagcaaatgaagccgctgctgctgcggcgaggcctggcatgaccggggaagaactggatgcagtggcgcggaagatcatagatgaggcaggatacggcgcatattttacacataggcttggccacggggttggacttgacgtgcatgaggagccttatatcgtagcaggaaacgaagcgcctcttttggcaggaaacgtcttttccaatgagccggggatctacttgccgggacggtttggagtccgacttgaggatgtgctttatctgagggaagatggggcagagtgcctgactggccttacgcatgatatcctgacgacggaataaggaagaggtggggatatggcaaaggaaatattaagagtggagaatctggtcacggaattctggggtgaagatcaccctacaaaggcagtggacggagtatccttccacgtgaatgaaggcgagatactgggaatcgtaggcgaatcgggctgcggcaaaagcgtgacttccatgtccgttatgcggctcattccggaacaggccggaggcgttaccagcggcacgattacatttgacggcagggatacgctgtccatggagaagaaggaattctcgaagattgaaggaaaagatctgacgatgatcttccaggagcctctttcctctctaaatccgctgctgacctgcggctaccagattgtggaaaccttgcggtaccatgaaaagataagtaaaaaagaagcctgggcaaaagcagaggaactactggagatggtagggattccgatgcctgcaaagagggccagggaatatccgcatcagctgtccggagggatgcgccagagagtcatgattgcaatggccatagcatgcaaccccaagcttctgattgcggacgagcctacgacagccctggatgtaacgattcaggcgcagattctggacatcctaaaaagacttaggcaggagcgcaatatggcagtaatgttcatcacccatgatatgggcgtgatcgcggatgtctctgaccgggtcatcgtaatgtatgcgggaaatgtggtagaggaagcgccggttacgcagttttttaagaatcctcttcatccatacacaaaggggcttctaaaagcgattccaagacccgatatgaagaatgaaaggctgtatatgatcaaaggcaccgtgccggggccggaggaacagtatgcgatgaagggctgcaaattctgcgacagatgcgagcacgccctcccaaaatgtagggaggaaaggccggctatgaaagacatgggcaatggccagaaaaccgcgtgctggctatatgacgacggcaaagggcctgcaaaggcgcggcagtaatctgcggcaccccaaatcaggagaggagaaagagagaatggaaccactttttgatatccgtcatgtttcaaaatattattcggcaaagtccggagcattttccctggacaagcgtatggtcaaggccgtggatgatatcagttttcagatacataagggtgagacgatcggcattgtaggagaatcgggctgtgggaaaaccactcttggtaaattaatcctgcatttgttcgagccgacagcgggagaaattatatttcggggacaggacatcctgaaactggaacgaagagaactgaggcagtttcgaaaacacgcccagatcgtctatcaggatccgtatacgtcgctgaatcccagaatgccaataggagagatcataggagaaccgttgaagattcaaaaactgggaaataaagacgagataaaggaaaaagtccttaatatgctggacgttgtaggtttggtaagagatttctatgacaagtacccttttgaatgctcaggaggccagaggcagagagtggggattgccagggcgctgatcttaagaccggaactgatcgtgtgcgatgaggcggtatccgcgctggatgtctccacacagtcgcagatcatcaatcttctggaagatatccagaaagagttcggcctgacttacttattcatttcccatggcctgtctgtagtgcgccatatctgcagcagggtgatcgttatgtacctggggcaggtcgtagagatggcggaatgcgaggaactgtatgaaaatcctcttcatccatatacgaaggccttattttccgcaattccgctgccggatccagagcaggagaagaaccggatcatgctggagggtgatgtgccaaatccggtgaacatcccacaaggttgtgccttccacacaagatgcagatatgccacgcagcggtgcaggacaatgcgcccaatacttagcgacgttaaggatggtcatcaggtatcctgccatctgtacagtaaagaggcatccgggaataaggaagagaatcctgcgccagcggaggtatgagtatggacagaaagaaaataagagaggatacgccctgtggaaacatctatatgaatcacgcctctacttcagttccgccattgccggtgatagaagcggcacaagactattatcgcatgatcatgcaatatggagccacaagcaggaaagcggaagagataacgatccgtacctgcaggcaggctgcggaaaatatggcagcctttctgaacgcggatgccggggagattatgttcgtgcccaatggtacggtggggattggcatggtagcgcagggaatgccatggaagccaggccagaatatattaatagattctatgagttttatcagcaatgtcgcgccttttatagaggcggctaagtcacatgggcttgagatccgctatataccggccaggctgccaggctttctcgacttagagaaactggaggagctgatcgatgagaatacggcgctgatcagcgtgacgcatgcggccaacagcctgggcgtgctccaggagattgagcggatcggaagtctggcagggaagtacaagatcccctatcttgttgatgctgcggggacattgggcgcagtaacgctggacgtacagaaaatcggctgcgatttcttaagcgcatccggccgaaagtatttaagaggcccatcaggcacaggcattctctatgtcagacaagaaaggatcgggatgctaaaagggtatatgccagcctggaacagcggtacctgggattatgggactgaggagtttacgtatcacaatgatatccgcaggctggaattcggagagaaaaactatccggggatattcggcctttctaaggctgttgaatatatcagcgaaatcggcggaatgcgcaggatagaggccaggatcagagaactgacaggctatctgcttgacaggctggaagccgttgacggcatcaggatattaggacctggggaggccgcctgccggtgcggcacaaccggattcatagtagaaggaaaaggatgtgaagagattgccggatatctgaataagaacggcgtcgggatgatggcacatcatttcttctgccctggagtcagcgaactgttcgaaatagaaggaacagccagactgtccgtacattattggaatacagaggaagagattgatacagtaataaatcttttgaagaagatgcagggtgaatagttatggaaagatattatcagcaatatatcaagctgcttgagaaagaactggttccggcttttggctgtacggaaccgattgcgatcgcctatgcggcggcgtatgcgaggaatattttggatgcaatgcctgaggaagtcgatatcaaagtcagcagcaatattataaagaatgtaaagagcgtcaccataccgaataccggaggcctgaaaggaatagaggccgccgtggcggcagggattgtcgtaggaaacccggaaaaggaactggaagttatcgccggggtatctaaggagcagatcccgatgatcaaagaatatctagagagggtaccgataaaagtctctgccagcgaaagcgatgaagtctttgatatcaggatcatggtgaagtgtaaaaagcagtatgcgctggtgaggattgtgaaagagcacctgaatatcgtgtacgttgagaaaaacgggaaggagatctttgaaaaggatgaagaggaccggcaggagcagccggaggcctctttgacgattcaaaaaatcgtggaatttgcagatctggcagccattgaagatatccggggaccagtccgcaggcaggtggattataatatggcgattgccagggaaggacttgccaaagaatatggaggcgcagtgggacgaaccatcctgtctcattcacagcaaactgccgctgacaaggccagagcctatgcggcagcaggttcggatgcccgcatgagtggatgcacgcttcctgtcattattgtatccggaagcggaaaccagggtatcacggcctcggttccgattgccgtatatgcagaggaaaagggctatggagaagagaagatgctccgtgcggtagcgctgtcagaccttcttaccatttatcagaggcagttcattggcaggctgtctgcctattgcggggcagtaaatgcagggtgcgcaagcgcagccggaattgcttatctggaaggaggaggctttgaagaagtagcacatactctaatcaattcgctggcggctatttctggcgtgatctgtgatggggcgaagccttcttgtgcggcgaagattgctgcgtctgtggatgcgggccttctgggatatgatatgtttatagataagaaagaatttgtcggaggcgatggaatcgttacctatgatgcggatgaaacaattaaaaacgtaggaatcctgggaaaagagggaatgaagcagacggatcgaaagattgtagaaattatgcttaagagaaccgcatgcagaaataagatgtagccgtatggtaaaatatggtataataaaagtgccttaagcccggtctgtctggcaatatacctatacagcatggaacgggctaataattaagaaagagcagggggataggtatgtctgaaacgatgaaactaaaagaccagatatatgagaaggtcctgaatgaaattacggaaggccgctatctgcagaatgaaattattacggaaagagaattgatagaaaaatatggagtcagcaaatcccctgtcagagaggcgctcattgaactttgtaatgaaaatgtactggtaagccgtccaagaatgggatatcagatacgccctatatctatgaaggaaatttcagatattgtagaactgcgggtaattctggaactggctgcgcttagaaagacgtttacaattttggatgatcatcatatacagctgctaaaggaaaatctatcaagggcttcagaaatccatgaagggaaaaatatgatgaagcattggaagagcaatatcagttttcatctgctgctgtgcagtttctgcggcaattcccaaatatattctgaaacggagagggcattaaagttctcgtatagaggcgctattcagtatttttctgtctcatggaaccgccgtcatgatacaaaggctcagaggcataaaaaattgatcgaggctatggagatgagggatctggaaaaatcgttggagatattgaaggaagatatagaaaatctgaagcaggagatattagaagagttttgttaggattttagcaaggaactgccccggcagttccttgtttcattttatgcctgcatatgatatagttgtcatagattataaaaaggagagcaaagaggggatatgaaaaagaaagggaaaattattttatcagcggtgctgatacttctaattatcctgattgtggcaatgtcatactttataggcacccaggtgttcgaaggatccacgcagctggtgacgaatgaggacactaagggggtaaaggattctttttggaagaagtacggaatagattaccaggaatttcagcgcacatacaaaatagaggatctggagttgaaatccacgttcgacggccataagattccggcagactatatctatgcgccggggatggagggaaacaaagagaatcaaacggttatactggtccatgggctgggaggaaaccggtactccaattacccattggcggaattcttcctggaagagggatacaatgtaattacttatgaccagagaagttccaatgaaaatacggcccggtatacgacctttggatattgggaaaaatatgacctgattgattggatcgcatatgccaaagagcaggccaatgaacagccgctgggagtatggggcacgtcctttggaggggcaacggccggactggcggcgggatatgaggatactgctaagatgattgactttctgattctggactgcccggtaagcagtatggaatatatgatagagcaggaaatgaagagcatggatacaggcattccggtgtcctatatgacttggtgcggcaatattgtcaataagctgaaactgggattttcgtacaaggatgccgatgtaagcaaagcggtaacagatgtggagactccgattttagtcattaacagcaaaaaggatgagttgacgccgtattttatggggaaggatatctatgacgcgatagaaggaggcaataagaagatatggaccgtgaaagacagcaagcatgcggaggtatggctggatcataatccggagtaccgcagcgtggtgaaggaatggatagagtttgaataagcaatgcagtcagttcgccaccgggtgaactttaaagtgtctggcagtccgttaggtcttagaaggagtgccatggcactttttattatgcaataggaggagtagacaattattatggaattaaggagagactttttgaaatatgtgagcctgaatgtgatcgggatgatcggaatatcctgctatattctggcggataccttctttgtggctaaggctctgggggctacgggacttgcagccttgaatttctccatctcatttttcagcgtgatgcagggctgtgggctgatgatcggaattggcggcgctacggacttttcgcttcgcaggcaggaggcagatgggaagaatggggatatttcctttgtccataccgtaatgctggggagcattgcagcagccctcttcttgctgatcgggatattcctggcagagccgctgggacgggtcttaggtgcggatgcgacgacgctgccctatacgaaagtgtatttgcagacgatcttatgttttgcgccggcgttcctcctgaataatattcttctggcatttgtccgcaatgacaatggaccccggctatcaatgacggctatgctggtgagcagtttttccaatattattctggattatatattcatgttcccgctctctatgggaatcttcggggccgcctttgcaaccgggctatccccggtgataagtattgcgatccttctgctgcattttaaggggagaaatcagggtttccatctgatgcggtgcaaattggagatcagaaggcttggaagaattatggcacttggcttttcttccctgattggggaactggcttctgccatctcccttcttacgtttaatttgatcatactgggaatctcaggcaatatcggggtagcagcctatggcatcattgccaacatcgcgctggttgccacctcggtatttacaggaactgcacagggattgcagccactggcaagcagatgctatgggcagggagaacgtgagggagtaggcaggctttccggctatgcggtaaagatggctgtttttttcgcagtggccatttatgccgtcatctgcatctttgcaccagcgatcgcatccatcttcaacagcgaggggaaccggaggctgtcggaactggcagtcgaaggaatgagaatctattttgcaggatatttctttgccgggatcagcattgtggccaccgccctgttaagcgctaccgcccatgtgaataaagcgatggccatcgccttatgcagaagctgcgtgattctggtgccatgcgtgttcttgctaagcaggctgtttaagatgacgggagtatggctgtcatttgtcgtggcggaagggctggtatttgtgctcacggtagtttttctggtcagattccgccgccgctagtataggcatatgccgggagcattaaattttgcgttttggaaggccctatgctacactagaggcaatgaaacggcaggaaggttgaaagcatatgctgcagattgcgatttgcgatgatgaaaagtattacagggaagagatacggagactgttggaagactggctggaagaaaaagggatggaatatgccatccatttatttgcttcgggagaagaattcctgatacagaatgagaatctggtaagatacgattgtatcttcatggatatcaatatgaacaaaatagatggtattgaggcggccatgcagatccgctcttatcattccaagacccagattgtattcgtgaccgcttttatccaatatgtgctggagggatataaggtagatgcagtccggtatatcatgaaggatacgttaaagacagcggtgccggagtgtatggacgcagtgtggaagagactgaggcttgcccaggtcacatttcactttgtcgaaggggagaagacgctttacacggataatattctctatgtggagagccgcaggcataaatcgatctttcactatatggaatctggtatgacggagtatcagatatatagcaagctggatgagatcgagcagaagttatacgagtatggattccttcggattcataagagttatcttgtgaatatgaagcatatgcgaagagtcagtaattatgaagccatgctggataacggcgaatgcctttctgtcccgcgcctgcggtttcagaaagtgaaagaggcatacgtagagtataaaggagcgttgtaatgagtgtcatattaaaatgcctggcgctatcgtttatgacggggatcgcctgtaagatattttttgaaacgctgataccaaggcgtaagatgagatatggctggatggaaaatacctttcttctgacgtttgcccttggatttatgatcatcagcatgaccccggttcccccttatatgctcaggccggtaagggtggttatcgtcatcttcattgtagtacagatttatttcaagatcaggcctttgcataatctgattttgtccatattggtatgcagtttgatgtggctaatggaaatgcttgttctttgggcgatttttgcactgcccgtcagatacaggacgcttgtatatcttgaggaagagatcgcatacagcctgctctttggcttgatgttcctattttctgtctgctataaggggaaaaagaatatgctgtctggcacgaactggattcgttatgggtatgttcctatcgtagtaatggtcatgattatggttttgagcagtattccctggaatgagcaggaacctgacggaaaagcaggatttctgctctttgccatgtttgggatcatgatgatgtttatcttttactttatctggaacattctgcaaaaggaaagagaattgcaggaactgcggatgattcaggagcagacgcagaatcagatggcgatgtaccagaatatgcagagaaattatgaacagcagaggcgctatctgcatgattacaagaaccagctggcctgcatccaggggatgctggcagaaggcgaagtagaaagaacagcaggatatgtggctgaattgacggggaatatccataaaagcgcagactatgtagatgccaatcatatggtggtaaatgtggtcctgaaccagaagtacagggaagccatggagaaagggattaccatgctcattaccataggcgatctgtcaaaacttgcgctgaaggaggaagataccgtcacgcttctggtcaatctgctggataacgccatagaagcatgtgagaaacaaaagactggtaaaatgatccactttaaaatggtactggaagacgggcagctggttctatccgtgcgcaatcccgtggaagagccggtcaagataaggggaaatacggtaattaccacgaagaaggataagtctgcccatggaatcgggttgaaaaacgttgattccgttatccaaagaaataacggaaccagcgtgattcagtgtaaggacggaatgttcagtttttctgccattctatcagtttaaggttttggtgttccggcatacataagatagccgcccttttccccgccgactggcccaagatcgatcatccagtcgctatgtgaaatgaactgctggttatgctccgccgcgacgatggtattgccggcatcagccaaacggtcaagaagcgccaggaaatgccggatatcactggggtgaaggcccgctgtgggctcatccatcaggtagaggcattctttattggaagcggtctggatcaattccttggccagccgaagccgctggcattcgccgccggacaaggtggtaagggactgccccagctgaaggtagttaagacctacatccataagaaggttcaagatccttaaaatcttggggacgtcggcaaagagttctgctgcctcttcaatggagaggttcagaacgtctttgatggaagttcctttataggtgacttccagaacttcagggcggaactggtttccattgcagacagggcagacgatttcggtattggcaaagaatagcatgttgttgtcgatgtatcccagcccttcgcagttttcgcatctgcctcctggagagttaaaggaaaaatgccgcgcacaaaggccattcttttttgcggttccggttttgccgaagacagaccggatatcggtgtagacatcggcgtaggtagccacattggaacgtttcatccggggaattgccgcctgctcgatcctgacaatcttatcaaatcgctcaaggccggccacacggccattctttgatgacccgcctgtagacaaaacctcaaagagcagggttgacttcccagagccggaaggaccggtaacagaagttaggcatccaacggggatatcgacggcaaggttcttaagattgaacgcatttgcatgttctatgcgaatcatagctgtaggctcccggaaaacggatttgccgggatctgggttcttaagatacaagccggttacggaagcaggatttcgcattagttcctttaacgtgccggaggcaataatctcgccgccaaatctgccggctccaggccccatatcaataatgtggtccgcagattccatgatgtccgtgtcatgctctatgacaagcacagtatttcccagatccctaagtttcttaagaattgccaccagcccgggcgtatctttggagtgcagcccggcagtcggctcatccagaatatagatgatgccggtaagttcgctgtccagggcggcggccagccggagccgcttgagttctccgcctgacaaagtgatgatctgccggtccagggagagatagccaagaccgactttttgataacggtcaagcttcgtttctatatcaagcagataggactctgtcatatccagatgcttgggggagagggaggcgcgtaattccttgatccattgccagagatgttccagagaataaagattaagtttgggaagccgggtgccgtgaacggttacgctacggcttaatgtgccaagtctttctccgccgcacttgggacaggattcggtagtgaaatagggagtcagcgaaccggcatccccggatctttcggacagtcttctccaaagaatcggaaatacgccttcgaatcttccggaagccgttgtctcaggcggttttaggcctggaaatgcctctcttgcctgggcgcattgtgttccttcgtataggattgctttctgcaggtccgtgaaatcctttactggcatattggcctcgtatggaatccggtaatactggaaggctttaaaaaggagcgaaatctgatactgcccgtatcgtttctcccaatagcgcacagcgccatcttctagagagaggttctcgtctagcacctgcgacttgtcgatggcatggatatgtccaagcccttcgcaagacgggcaggccccttcccttgtattaaaggaaaagaaggtgcgggtgatcttgtccattctttggccgcattcactgcaatacatatatacatggaaatcagttccttctttcctggtctcttcccggcagtcggccgcgcagatctgacgcccgcaataagggcatgtccgcatgcctagtttttcgtatatcatccgcagatccgtatagatatccgacaaagtcccgactgtggaacgggggtttcgattggcgtccgtctgggtgatgacgatggccggagaggcccctctgatccggtctactttcggcttgcggattccctggaaagacatcgcctccaagtattgccgctggcattcgttgaagaggacgtcaataagcagcgtagattttccgcagccggacaggccggtgaatacgaccagctgattctttggaatctctaatgatacgttctttaaacagccttcccgtgcattgctgatttttatataatccataggcacctcctttgggcggatgactttgctttgtctttctattatagccagatgatcatgctgtggcaaccgtgtgtttatactggtctttttttgccggggcaccgtatgttggtgctctccttcttgtgtaaaatacatgactttcatagaatgaaggggaagctagttaattatgtcagaacctattcgaattggcttgggattcctaagggcagagagtatcgagtgtttggcgaacttttgcagccaggagcgattaaagaaaagcggtatgaggataacaggaagtttgccgaagcaatcgtaaggaacctgtcttgggacatcgaggatgtacgcatcaaaggagataaggcagaaatagatctgaaggttacgaacacggatatgtctgatgtgacaggatattatatgatccaggtaatggaggatatggctggcaatgctgacacaggcattttagggacgatatcggatattcttgaaagcgcatatgaaagcgagagcctccttccgtatatggagaaggcagacggcattattacgatgaatgtgactgttgccgcaagcagaagaaagggagcgtggaaggtacacgtaagcgatgaattcgtcaatgcgttcatgggaaatttagattctgaggactattcgcaggaggtagaggaacgtctggacgaactggaggcggagatggaatcaaaggcggaatacaaaatttccttgacatctttggcagaattatacagaatgatagagtaaatggttatgatgtatcatacagaaaaaaggaaatgatgatggcaagtaagaagaaaaagatgatcccgccagttctgccggaggagtttcgaagagtcgagagtaccggacggatactcaaggagtttaagtacagggaagaaagagtgacggaaaccgtgctggaagagatagcggcagaagaggaggactattcccatctggtcttttcggcggtgaagttcgtaaactgccggttctggaactgctcattcgagcgctgcgagtttacggatgtgatattcgaatcttgcgatttttccggctgcaatctgtcgaatacatattttaacagggcagaatacctatcctgcaagggagtgggcacgaagtttgctggaagcgtatgcaagaatatggtattgcgggaatgtaatttgaattatgcgaatttcgatgcctgcaagctggagaatctgctggttgataagacagaactgaacagcagcaatcttacccagtgcaaatgcaaggatatacagtggaggcaggcggcacttacgaatgccagtttcttcaagactccgatgcggggcatggacttttcagacagcgagatcaagggacttgtgctatccgatgacaatcaggaattaaaaggcgcagtggtggatttgtaccaggccgcgcagttgtccaaaagactgggaattattataaaagatatagaagggatataaggaggaattatggaagaagttacgtttagaaaggcggtcagagaggatgtgccgcttattttggaatttatcaaaggactggcggaatacgagaagatgtcggatgaagtagtcgccacggaagagatactggatgagtggctgtttgacaaagaaaaggcagaagttatatttgcgatagcagaaggggaagaagtaggattcgccctgttcttccacaatttttccaccttccttggccgtgcgggcatttatctggaagacttgttcgtgaagccaaagtacaggggaaatggatacgggaaggcaatcttgaagcgtctggcccagatcgcggtggagcggggctgcgggcggctggaatggtcctgcctggactggaatcagccaagcattgatttctatctgtctctgggcgcaacgccgatgagcggatggactggctataggctgacaggaaagacattggcctatgcagctggcgtgcaggattgatggattttgtcagcaggacgaagggaaggggccttaagaagggcgccttcccttcattctatcaggaataatctttgctatttcttcgccagaatacacaaagtctgctcccctttatcataaggcttacccatgacatttccatatacggcaatctcgctgaagccagcgtcctctaagtctctttttatctctggaaacgtaaagacatgttcccagacattatagaaagaaatggtatcttcgctggcaattacatatcggttcagaaaggtactgtcctcgtcataacgatagaaagaatggagcagcaggtgaggctcttctttccagaagccgttctcgcagacatcccaatgcctgaattccctggcgccttcatatctcaaaggcgtaaagacatcaaataagaatacgccttgcggcagcaaagaatcgtgtatctttaacagaagttctttgcggtcgtcaaatggaagaactccaaaatcacaatagataagcgtgactaagttatactgggagtcaaaagccatctttgtataatcgccttgcttatattggattttcaaacctagggcgtttgccgaattacgggcgtatgcgatagaccggcgtgacaggtcaaggccggtgacgcggtatcctttgccgtagaaacgttctgcatatatgccgggcccgcatccaagatccaggagtagaggatagtcatgaggaggaagggtggatgctatccattcgacagattccttcacggtcgccagttttcttgtagcggactccaggtcttcatccagatgggctttcagcatatttttggaaatatacggttcatcccacatgttttgggggccttgttcatataattccggctttttacttgcaatttttattaaatctttcatgcgtgttctccttttgatttgttatgggtacggcaactggctgatttatatacgccttggcggcattctattatttgaaaaaaactaaaccgtggatttctccacggttagaaatccacggttcactcatgttgccgattatacagcatcaagtgcgccggatcttaccatctcctttgcagttaccgtaacctcattatagggcggactggatcaaatatcaatcataaaacggcgtgtcacgcaatgcattgcatacgcagaaataatctgctagaatcaggggatgggaaacagaggattccactgttggataaggagcatgaatttgaagaacaaaacattttacaggaatttcttttctatttacatagccctggtattgcagaatgtggtgacgctgagcgtcaatcttgcggacaatatgatgctgggcgcatacagcgagacttctctggcaggcgttgcggcggtgaaccagatacaattcgtctatcagcagttcctgctggccttaggagacgggcttgtaatcttttgcagccagtattggggcaagaggcagaccgctccgatgaagaagattgccgcgacggctatgcatgccggacttttgattgccattgcgctgtttgtcctggtcagcctgttttcccggcaggcggttggaatctttacgacggacggcccgatcattggggaaggggtaaggtatcttcggattatccgttttacctacctgttctttgcggtgacccagctccttctggcggcattaagaagcgccgagaccgtcaggatcgcgttccagctctccatccttacattttttataaattgcggcattaattatgtactcatattcgggaatttcggagcgccgagaatgggcgtacgtggagcggccgtggggacgcttatcgcaagaatgatagaatgcgccgtgctgatcgcatatatcgcaaagaaggataagaacctgaaccttaaactgaaagattaccttcaatttgaccgggtgctggcaaaggattatttcaaagtgacagccccgatgctgttcgtccagggactctggggcgtcaatacggcattgcagacggtgatcctgggacatatgaaggcaacagccattgcggcaaacagcgtggcatccactttgtttttgatggtgaagtcaacggcggtaggcgcatcctcggcagcatcggtaatcattggaaagacgataggcacgggggacatcgcaagggtcaaggagtactccggccgtcttcagaagatgtttatcgtaatcggcgtgctatccggcatcttcctgttctttatccggattccggtcctggggctgtatgatctccagcctgccaccaaagagatggccaacgcctttctcataattttaagcgtcgtctgcgtcggcatgtcctaccagatgccgaccaacaacgggatcatccggggtggcggcaatgccatgttcgtggtcaagatggatcttgtcagcatctggatgatcgtattgccattgtcgtttattatggcattcgtggtaaaggcatcgccaatcgtggtagtatgctgcctgaacgcagaccagatattcaaatgcgtgccagccttcctggaatcccattatggaaactggatccgcaaactgacccgggaggcttaaggcgctataggctttcaacaaaatgccttagttccggcgtcagttctccctgcttccaaacggcgatgatttcctcggcttcttcctcgccgattagtggtatgaagaccaggttgtccgcgttggtcaatttattagtaatataggaaggcatgacggagatgccttcttctgccgctaccatcatcagaatactctccacatcgttggagcggaacaggatgttaggctggtagccggcctctttatacaggtccataaaatggctgtctccgaaggagtcgccggtactggatggagtcatatataagatggcttcattttttaattccctgcggttaagggcagagcgctgggcgaagggatgtccgctgtagagggccaccaccagaggggcgcgctcgatgatcttatggctgatggcatgttcttgcagaatattggtgctgtcccaggtgaagatgatgtcatattcatcgttaaacaggcctgccgccagccggtcggtatcacagcgatagcaagtaagaagaatgttgggatattccagatgaaaggcccgcagcttattggagagatcgcttcgctcgtagcctttagtatagccgatgcgaagagttcctaccaggccggtagaagcatccttgactttgctgaccgcagtctccatccgctccagaatggcttttgcctccaggaagaatatccttccggcaggggtaagcgctaccgggcggctggaacggttgaacagctggacgttcatcgattcctctaaagcgtgaatctgctgggtgatggcggtctgggatatataatactggtttgcggccttggtaaaacttcggtattccgcgactgctacaaagtatttcaattgattggtattcataaagggctcctgctgaaattatttgattgtttttttgtattataactatatcttatattaatatgagaaataagaatttgcaatcctgataagatgtaattataataataaattgttatggtacaaaggagaggtgtaaaatgaagagagaaaaatttggttcgcgtctgggattcatcctggtgtctgccggatgcgccatcggaatcgggaacgtatggaaattcccttatatgtgcggtgaattcggaggggccgcattcatattgatttatttattattcctggttattctgggaatcccagtgctggtgtgcgagttcgcggtaggacgcggcagccgtcacagcgtggcggcgagcttcgaggcattggagccggaaggaacccgctggcatatgacaaagtggatcggagtgatcggaagttatctgctgatgatgttctataccactgtaggcggatggatgatgtattattgctaccggagcattcggggagaattcgccggcgctactacggatgaggttacggcaggattttcgaatatgctaggcaatgtgccggtgatgactttctggacggtactcatatgcataattggattcgcggtatgcctgtttggaatccagaaaggaatcgagcgggtatccaagattatgatgtccgcgcttttgatcatcatggtagtcttggcgattcattccttctttatggagggagccggggaaggcatccgcttctacctgattccggattttggaaagatgctggatcagggaatcggaaatgtgatcttcggagcattgagccaggctttctttacgctgtccattggtatcggcgcgatgttgatctttggaagctacatggataaggaaagaagtcttaccggagaagcggtgagcatcacggccctggatacgtttgtcgcgctgatggcagggttcattatcataccggcatgcttttccttcgggatcgagccgggatcaggaccgagcctggtatttatcacgattccgaatatatttgcccagatgacaggcggacagttatggagcgccttgttcttcctgtttctgacgtttgcggcattttcaacgattgttgccgtgttcgagaatatcatatccttcgatatggatttatttgactggtcaaggaataagagcgtcctggtcagcgccgtgctgatcatcctgctcagcatgccctgcgtcctgggattcaatatccttgcgggattcgagccattaggaagcggaaccaacatcatggatctggaagactttatcgtctccaacaaccttcttccacttggaagtctgggatacgtgctgttctgcaccagaaagaacggatggggatgggataatttcctttcggaagtcaataccggaaaaggattccatttcccaaaaggcctgaagaattatgtgggctatggaataccgctgatcatcattatcatctacctgaaaggctattatgataagttcataagccagggaacgacggtactgctggtgtggatggcgattgcgatccttctgcttggattcgtgctgtattgctccggatcaaaaaagaagcagtcataaactaaaatagtacaagaaaacgtaataattctacaggagtctgtggcaatgtaatccttaagattacgacgcaggctcctgcttgatttttcatagtctgtttgctatactggcactatatcatatcaaggacagaaccttatcgaaaattcttaactgtcctatctatccgtttttcagggtgagtcagccaggaaattcaagttgatggcaacaaaataagtcttatattcattgaaagcacactgggaaaatattataatgaaaggaagaaagtgtatgagggaaatggaaaaactgaatatgcagatgccggaagcgccacaggatattatagcaccattaaagaggctgaatcttatggatgatttcctgtttgatgtgactacggtaagccttgaggcttgtaagatcattctggaattgtctatacgcaatgtaggaaatatcccaaagcgaacccgcttttatcaggctttggttgatgccccgctgcttaagagtggagaacagaagtttgataatctgaataccacatatatagtggtgatctgcggttttgatctcttcggcttggggaaatataagtatacatttgagaatcgatgcgaagaagtgccggaacttgtgctaggggatgaatgcaaaaaaatcatcctgaatacaaagggaagaaatgatgaagaagtagattcatcgctggtagatttccttcattatgtggaaaacagcacgactgaaaatgtacccgaagagtgtgatgactgattgaaacgtctgcatatgatggttgaagagatcaaggccagcgagcagatgggagtgacatatatgaagatggaagaaagagatcggcttcttagagaagagggaagagaagccgggagagaggaaggagaaatgcgagttttaaccacacaggtgtgcaaaaaacttggaaagggccttgaggttcaggcaattgccgagatgcttgaggaggaagagcctgtgattcgaaggatttatgaggctgcgattccgtatgggccggaatatgatgtagataagattctggaaagattaaataacgagaaataaaaaacaggaatataaactccactgtacattcatttggcgtacagtggagtttttgcctagtctaattcatggctccagtccttgacataatccaggaacttaaggatggccagagaaggaggcgcgtccttggagtatgcgacgcccaggacgcgggagtaatgctcggtaaaggagcggatgcatacatcaaaaggcgcattatataataaaagtctcgggaggatcgtgacgccgaatcccttttccaccattttcaatgtggcaaagtcttcattcaggcgatagcgtatcctgggtttgatattgttaagctcgaagatctttccggtttcataatccagtccgtcggaagacagcacgaagtcttcattattaatgtcggacaatgatacggccaccttttcggacaaagggtggtctttgggagtcgccagcatcagttcgtctttgccgatggggacaaaaggaagccccggcaccgagtagcgggatacaaagatacagtccaatttccctgcgcgtattttttctcttagcgcgctgaatccgtcaaccgtcatttcgaagcggatatttgggtaggcctttgaaaagtttttcaggatatccggcagccagtggtaggagatgctctgtatggtgccgattcgtatgtagccgctgtccagactggtaagatttgtggcgatctgggtgattctattttcttcccggcagataatcttaagcgcttcgataatttcttccgtgttgggcatcagttccattccatgcttggagcgtttgaacagctgcaggcccagatctttttcaaatcctttgattgcctggctgattgcagattgggtatagcatagtttttcggctgttttagatatactgtgagtctcgcagacgcttaggatgatttcatatttgttcatggcaactcctttacattagaaaaattaatgccttcgttaagtaaaactgaattaaaggaccaaaatcgggcttttcctcaaaacataagtaaaactgaacatttccttcagtaaaacgctcttttgaaattccttcggattctatattataaacacaagtgataaatttttgtcaaggtgataaagggaagaaccggacaaatcaagaaaaaggaggaaacaaaagtatgggtacagaatattggaacggagcagaagcagcgcacaggcgggttatgatgaaggcagccgggtattcggatgaggatatccgcaggaagccgcacattggcgtgcctaattcatttatggagggatcaccgggaacggcgcatcttagacgcatctgcgatgcggtgaaggaaggaatctgggcagcaggcggcgttccggtggaattcggaattccggcgacctgcggaaacgtggccaatggaagcgatgagatgaaatatgagcaggttggaagagacattgtggcgatgtctgtggaattcgtctcccgcgtgcatcatttcgacgggctggctatgatcgcatcctgcgaccttattattgccgggtgctacatggcggcaatgcggctggatattccatccatggtcgtaacaggaggctccatgacggcaggccagcactgtggcaagacggtggtagaggcagacctggacgccgcacgctttacaggcgcggacgaaaaggaactctttgaattagaagaatccgtatgcccttcttacggtgcttgtccttccatggggacggccaatacgatgcagatgctgggagaggtgatgaacctggtgcttcttgggacggcgacgactccggccagcgataacgcaaagatccgcctggcaaggagcgcgggcaagtatatcgtagaaatggttaggaccaatagaaagccttccgaattgattacaaaggaagtactcttgaatgcgattatgtttgatatggcagttgcaggatcgaccaacgcagtgctgcatcttctggcatatgcttatgaattgggaatcaagctgacatatgaagattttgataaatatgcagaagaaataaaatgcatcaacgccgttattccaagcgggccttacaccgtggtagacttccactacgcaggcggcgttatgaatgtaatgaagcagctggaaggcaagctatttacggatgccccaagcatctatggtaccacttggggagaaatgctctccaagatagaggcgaaagagaataaggttattcactctcttgaaaatccagtgtctacccttccgggcctgaagatcatgcggggcaatattactccgaatggggcaatcgtgcgcccgacagccgtatacgaggaagtaaaatatatcaaaggaaaagccaaggtatttgaaggagattatccggccttcgaggccattcagaacggggagatcgttcctggcgatattattgtcatccgctacgaaggatgcaagggagcgccgggcatgaaggaattgatgctcagcatcgacgccctcatcggcaaagggcttgacaagagcgttggccttgtgacggacgcaagattctcaggattcaattatggagccattatcggccatgtatcgcccgaggcatatgacggcggcgtgatcgcgctggtagaaaatggagatgagattgagatcgacattccaaaaggaacggttgaccttctggtatccgatgaggaactggcggaaagaagaaagaactgggtatgccctccgttaaagcagcagaagggatgtctcaacatctatgcccagatgtgccgcccggcagaagaaggcggagcaatgcagccgtggccgctggatgccaagtattacgtgtaatcggagagaggaggatatgacatggtactatttttcagggttgttacaattactattttaattgcatatgcaatctatatgtatcgcgatatcattaagcacaaagaaaaagactccttttttcatatgatactgtacggaattatgggatttgtcctgaatcttctggatacacttggcgttggaagcaatgcaacacaaatggcatttttcaaactgaccaagcttagcccggacgagcaccttcccgcgaatggaaatgttatatttgcaattccggtcggagtagaattcctgctattccttgatattgtagaggtagatacagtcacattaataaccatgctggtttcatccgtgctgggagcgattgtaggggcgaggattgtcagcaggctgccggtgaataccttgagaaagatcctggctgtcatactgccttgcgtagcggtgattctgatctgcaagttaaacggattcggtccttttggcatgatgggggaagaaataggacttacgggaggcaagctcgttataggcattgtagtcaattttgtattaggagcattgatgacctgcggggtagggctatatgcaccatgcatggcgctatgcgcgctccttggaatgaacatttccgttgcatttccgattatgatgggctcctgcgcgtttctgatgccgcccgccagcgtggaatttgttaaaagcgggaaatataacaggcctgcagcggcaattgcgacgatcacgggaatctttggagtattagcggcgtactatatcgtaaaatccatgccgataacgcttcttacatggattgtcgcggctgtgctgatttatatgtccatttcatttgtattgactttgaaaaaagagaagtaatgatcaagaacaagttgaatcgtacatataagtaaggtattataaaatataaggatattaaagaggaggataatggtatgttactattgtcaagagaggacattaaaaaagtatttacaatcaaggatgccattgaggcagacaaaaaagcatttcaactggtagtagaaggaaaatgcgacgcgccgcttcggacgaacatccaggcgccaaagcatgacggatgcttcctgttcatgcctgcatacgtagaggacatggagaccgcatccttaaagatcatcaacattttcccgcacaatatcgataacgggattccgtcatctcctgcacaggtactgctgattgacggaaagacaggaatcgtgatagcggttctggacggtacctatgttacccagcttcgtacaggggcagcatcgggggctgcctttgacgtgctggcgaagaaggactgcaggattggagcattgatcggaactggcggacaggcagcaacccagcttgaggcaatgatcgctgcaagaaaactggaagaagtcagagtatacgatctcaactttgaaaggacaaaagattttgcagcccgcatgcaggaagaattaaaggattacggaaccaggattgtcgcagtagaaacttctgacgcggccattgacgatgcagaccttctgattacggttacgccgtcatccaagcctgtattcgatggaaccaagattaagaaaggcgctaccatcagctgcgtgggggcttaccagcatcacatgcaggagatggacccagccatccttccaagagcatccaagatctactttgattccgaggacgcagtattgtccgagtcaggagacatcctgatcccactggaagaaggaatcattacaaaagatgattttacaggagacctgggcaatgtcatcaagggcgaactggtaggacgcgagaatgacgacgagatcatcgtattcgagaccgtaggcgtagccacgcaggaccttgtggcagcaagagaaatctacgacaaggcagtcaaggccggagtcggcacagagtggaactagaagttcattaaaactatatttataattaggaggaagccattatgccacatatttcaattaaaatgtatccgggaagaacggaagaagtaaagaaggatctcgcagaaaagacaaaagattttatctgccaggaaatgaatatggaagaaaagtacatatccgtctctgtggaagagattgaaaaagataaatggaatgaagaagttgtagataaaatcaatccagacgatctgtatgtaaaagccaacttctaacacgtaacatttttcactttgacacgtaacaaaatgcaaaaatgttacgtgtcaaacctacacaactggtgtaccaaactggcaaaagccatgtgtaaaattgaaaaaatggtgtgcagaattaaaaatcaccttaataaaagacaacttatcaggtaaaatatatactaaaggccttgataagttgttttttgctgcattaggttcctatgcctcattttgagacgggattttttcattttgacacgggggttttgttagttcaacgcaccagttgtgtagggatagcacgtaacaaaatgcaaaagtgttacgtgtcaaagtgaaaaatgttacgtgtcaggttaaaaaaataacacttcgcgcagtcaaaccaacgttttgaacaaaaaccattgaaacattgttaaaaaagtataaaatatagacaaacatttgaaatggccatttcaaaaccggaacgaaaatctaaaatggaaaaggtgaagagaatggagaagaagaagggactgtcaatatcgcttacgacccagattctgatagcgacagttggcggaattatatttggctcgattgtagggccatgggctgcaaatttaaaatttatcggggatatttttatccgactgattcagatgtccgtagtgcttctggtaatgtctgcggtagcggcagcagtaggaagcggagacagccaggatgttggaaagatgggattccatacgtttaaatggatcatattttttaccgtaatatcagccggactgggcgttttactggccatgctgatacagccaggcgtaggcattgagatagcaagcgccgaagaagtggcaaatgcaacggttgagtcaacctcgctccaggagacaatacttggattcgtgccgacgaatatcatcggctcgatggctgacagcgctatgatgccatgcatcgtcttcgcgttattcttcggaatcgcaatgggcgcatataccagacagagcggcaaccgcaatatggtggaatgggttaccggactcaatacgatcattaccaacatcattaagacggtcatgcacatcgcgccaatcggaatcttctgcctgcttgcaaatgttgcaggctcgacaggactgaaagtaatcattccgatgatgaaattcctgggcgtgcttctgattggagacttaatacagttcttgatctatggtccgctcacagcagcgctttgcaaggtcaatccggccaagatgccgaagaagtttgccaagatgtctatgatggccgtaacgactacttcaggagcaatctgccttcctacaaagatggaagatgcagtgacgaagttcggtatcagccgcaaggtagcagattttactggaccgattactatgtccatgaatagttgtggcgcagcgcagtgctacgtagttgcgatcttctttatggcccagtctaccggcatcaacatgacggtatatcagatgggaatggcaatcctgctgtcctgcctgatgtgcatgggaaccattgcagtaccgggaggctccgtaatcgtatatacattccttgcttcatctttgggacttccactggaaagcatcgctgtcctgattggaatcgactggttcgccggcatgttccgtacgctgatgaatgtggacgtagacgttatggtcggcatgcttgtggccaataagctgggagaactggaccgggatgtatacaacgacaagaaggcagttacatactaggcataagcatagttcaataagtaaatgagattacacatgacatttcccaactattaatcatacattattttcaaggacccctggcatattttaaatatgccgggggtttttgaggctatatttggaaaccatttgaatcctgtaatggattgcaatgggataagcgacgctacgtattcgcaggaggcgcaagagaagaggtgcaagcgggcctacgcccgttcttgtaaccttccccaggctgtgataagataaggatacgagagaaaaaggagaagggatatgcagacgaatcagctggtatttgagttaattatgaacattgggcttatggtactcgtggcaagcctgctgtcgaagctgcagctggtccaggatatcatcctgcaggagaagaggaattggaagagccaggcgcttctgtcggtgatgtttggggccatcattattctgtctacgtataccggaatcgatatcggctcttacagcctgaatacccgggtgatcggcgctatggcggcgggccttctgggcgggccgctggtaggcctgtatgcctccatgataggagcggtctatgtctacctcttttcggcgccccaggcatttgccatggcatccgctttctccacagtgctgttcggccttctgggcggaggcttctatccatatttccagagagggaaatggaagtacaaggatctgtttttgctggcctgctttgcggaagtctgcgatatggtatcccttcttcgctttacggttccggtacagatggcgctcaagaccatattggagatctcggggccgatgattcttctgaatgccggcggaatcctgatctttatctccagcttcaacaatattttcatcaggcaggatttggaaagcagccgccagctgcagcgggcgtcagatttgtcgaaacggtgcctgcccctgctggtggagggactgcacaaaggggaaaatatggaggaactggcttctgtcctgctggaagggacggactgggcaggggtaatggtgacagacgccacatccatcctggagtggaaggccaaggaggtggattaccagcccgaagatgacgccattccgccggtgggcaaggaagcccttaagacgggacaggtggctgccgtatatcaggcatccagggatagttccgactatgaatggctgaagaattattccatgatagcggcgccgtttatcataaaagagcagcccatcggctgcctgatcgtgtgggtcaagaagaagtgggtgctgcgtcagagcgagatggaactgctgcagcatctggtaaccattgcatctttccagattgccatggcggagctggagcaccagaagacgatgcgccagaaggcagaattcaaggcgctgcagttccaggtgaatccgcatttcctgttcaatgcgctgaataccatatcctgcgtatgcagggagaacccggagagggcaagagagctgctggtcacgctggccagctatttccgctataatctggattatgaagcatacatggttcccatggaagaggaactggatcatgtaagggactatctggaactggaaaaggcgagattcgaggacaagcttctggtgacctatgaccttccggaatgtatggacatacagattccgacccttatactgcagcccatcgtggaaaatgcggtgcgccatggaatcgaccggaagggaaaacgcatcgtacatataaggatagaagaagcagaagacgcgtttatcgtgcaggtctgcgaccaggggcagggctttaagccggaggttctggagaaattagaaaatggagagcctatcggcaagagtattggattaagcaacgtgcacaaacggatgaagagtacctatggcgaggatggaggactgaagattgaaagttcgccggaaggctcctgcgtggaacttcagttccggaaggaaagagtgaaggagaatatttatgaggatcgcggtaattgatgatgagagaccggcaagaagcgaattaaggcaccagcttctggaacttcttccggatgcggtgatcgaagaaggagactgcggggcaaaggccctggagattgccggggaagagaagtacgatatctgcttcctggatatcaatctgggtgatatcaatggcacagtcctggtcaatgcgctgcggaccatgcagccggagatgaagatcgtctttgtgactgcctattcggagtatgcggtacaggcattcgaactgggagtggaagactatattatgaaaccctttgacaggaagcgcctggagaaagtgctccgcagatgcatggcccagccggatgctgcagcccgtactgaagcgccatcggatcgggcggctgtaaaaaggctggctatcagcagcaatgggaagactgtctttgaagatatcaaggatatcgtctatatcgagacgtacaacagaggctgcctgattcatacagtaggcaatgagtaccgggagaataagcccatcggcgagtatgaaaagaagctggaagacatggggtttttcaggatccataaaagttatctcatcaatctggacaaggtaaaggaagtctttccatggggaaataacagcttcagcctgaaaatgaaggggtacgaggagaatattcttccgatcgggagagacaagacaaagatcctgcggcagaaactgggatattaagggagcaaattgacaggcgcacgcttaccctttatgattggaaataagaaaagacaggaggtactaagaaaatgagatatcagatacaaggcgagacgcttccggtagtaatctgcgaactggaaggcggagagaagatgatcaccgaaggcggaggcatggcatggatgtcccccaacatgctgatggagaccaccaccaatggcggcatcggcaaggcgtttgggcggatgttttccggtgagcatatgttccagaatatctatactgcgcaaggagggccgggaatgattgcgtttgcgtccagttttccaggatctgtccgtgcattccagattgctccggggcaggagatgattcttcagaagagcgcgttcctggcaggagagatgggaatcgaactgtccgtattctttaataagaagtttagttccggcctgttcggcggagaaggattcattatgcagaaggtaagcggccatgggatcgtgtttacggagtttgacggccatgtgatagaatacgagcttcagcccgggcagcagatcgtggtggatacgggccatctggcagctatgacggccacctgcagcatggagatcaagagcgtgccgggcgtaaagaatatgctgttcggcggagagggaatcttcaacacggtaatcacagggccgggaagagtatggctccagaccatgccaatcagcaacgtggccggagcattaaggccatatattccaaccggtgcataatccggccaggagaaggaatggggctacagattttcatccatatgctgcctgcggtactggctgggcgagcagcccatatatcgcttgaagatctggccataataggccggcgtggagaatccggccatgccggctgtttttgtaacgctttccccgtttttcagaagcaaaaggctgttctggatccgtaagaacaggacatactcaaagatggtcatcttcatatactttttgaagaacctgcagcattcactcttgcagatattgacatggctggctacatcatccagggtgatctcctgggcataatgctcctgcacgtaagtcaggatgtctttcaggcgctttagatgcttctggggatgaagaaggcttacggacggctgggagacataatgcagataaagcttctgccagatggaacacaggatcatgtgtacctgaagctcataatcctcaggtggctcctgggccagctggcagatgtcctgaatctggcggatgatgtcctggtgccaggttacatctttttcgaatttcagggaatgccatagttcattggaagtaatgaagtccacatacttggtttgaagcaggctgttctcatatccgtagatgaagcggggatgaaaggtgacggacagatagtcgcagtcctgcccgtccttcatgtagccggaatggagggtgttgctgttgccgaacagcccctctccctcagaaagaaggtatttctggtcgttgacataatactccatctgcccggatatgatccaggtaagctcgatctccgggtgccagtgccacaggaaatacccctgctcgtaggactggatggattccgggctgatgttgacgggaaattcataatttccatgacgtttgatctctttttggtttttttcggtatgtatctgcaccataatcacatttcctcaatatccttataattttatcaaatattcttattgtacgctgggattcatctcattataatcataaattagataagagggatatgcaaggaaaacataaaagcgaataaggataaatggaggttaagaagatgaaagagcgtttcattcagaagtttcaggaattgtatgggaaagaagacgggatacgggcctatttcgcgccgggacgcgtgaatctgatcggagagcatacggattacaacggaggccatgtatttccctgcgcgcttacccttggaacctacgggattgtaagggatcgcaaagaccggaagctgcggttctattccatgaattttgaaggcctgggaatcatagagaccagcctggatgagctggtcccggacgaggcggccaattggaccaactatcccaagggcgtgatgtgggcgtttgaaaagcggggttacaagctgactcatgggatggacatcctgatatacggcaatattcccagcggttcgggactttcatcttccgcatccttagaagtcctgacagggctgatgcttaaggatacattcggctttgaggatctgaccatggtggaagtggcgctgatcgggcaggattctgagaataattttaacggctgcaactgcggaatcatggatcagttcgcaagcgccatgggaaagaaggatcatgccatcttcctggataccaataccttgaactacgagtatgctcccgtgctgcttaaggatgccaagatcgtgattaccaacagcaaggtaaagcacagcctggtagattctgcctacaatgacaggagaaaggaatgcgagacggcgcttaaggaattgcaggaaaaacttcccattcagagccttggggaactgacgcaggaagagtttgaattacataaaggggcgatcaaggacccggtaagacaaaggcgggcaaagcatgcggtatatgagaaccagaggacgatccgggcagtggaggcgcttcggggaaatgacgtggaactcttcggaaggctgatgaacgaatcgcaccagtctttgaaggaagattaccaggtatcctgccaggagatcgatattctggtggatctggcgcaggcgatgccgggagttctaggatcccgtattaccggaggcggatttggcggatgtaccgtgagcatcgttaggaatgatgcggtggatggctttatcagccagattggaaagacttataaagaaaaagtgggccatgaggcggaattctatgtagtggagatcggcgatggagcgaggatcatatagtcccgctgtggatagaaggagagaggattatgctatttgaaaatattaagaaactggtagaatatggcgtccagacaggattgacgccggaatcggagcgcatctataccaccaaccttctgctggaaatgtttggcgaggataattatgaagactgcccggtggaagatacagagattgaattagagtccgtgctgaaggaactgctggatgaggcagtaaaaagaggaattatcgaggacagtatcggataccgggacctctttgacacgaagcttatgaactgcctgcttccaaggccggcccagatacaggagacatttgcgaagaaatatgagatatccccgcaggaggccacggactactattataagttcagccaggacagcgactatatccggcgctaccgcgtgaagaaagatatgaaatggaaagtggattccccctatggagagatcgacatcaccatcaacctgtccaagccggagaaggatcccaaggccattgccgcggcaaagaacgccgcggccagcagttatcccaagtgcctgctgtgcatggagaatgaaggatatgcgggccgcctgaaccatccggcaagggaaaatcaccggatcattccggttacggtcaacgacagcaagtggggattccagtattctccttatgtatattacaatgagcactgtatcgtattcaacgggcagcatgtgcctatgaagatcgagcgggccacatttgtgaagctgtttgacttcatcaagttctttccccattatttcctgggctccaatgcagacctgcccatcgtaggaggctccatcttaagccatgaccatttccagggaggcaattatacatttgccatggcaaaagcgccaatcgagaagcaggtaacgataccgggatatgaagacgtggaggccggaatcgtcaagtggcctctgtccgtactgcggatacgaagtaccgacgaaaaacggctcatcgacctggcggaccatatactggcagcctggagaggctacacggatgaggccgcattcatctatgcctgcacagaaggagagccccacaatacgattacgccaatcgcaagaaaggtgggcgatacgttcgaactggatctggcgcttcggaacaacattaccacccaggagcaccccttaggcgtgtatcacccgcatgcgcagtaccacaatatcaagaaggaaaatatcggccttatcgaggtgatgggacttgcggtcctgccttccaggctgaaggaagaactggagatactggccggatatcttgtggaaggcaaggacatccgaagcaatgagaagattgaaaagcatgcagagtgggtcgagcggttccttccggattatgacaggattactggggaaaatgtcatggatatcctgaagaaggaagtgggcaatacattcgtccatgtactggaagatgccggagtatacaagtgtacgccgcagggacgggaagatttcatgcggtttgtggataccttataagcaaaatgatagaaaagaataatagaaaagcaggaaggacacgcagggcattaaaaatgccgcgtgtccttctttaataagatccttttaccctagatcaatgactggaataatgctgtaatatcctccacagaagtttcctttggatttcccggacggcatgcgtctgcataggcggattcagccaggaacggaatatcctcttcttttacaatgccttttaggtccttagggattccgacatcctctgccagcttccttacagcgtctacggcagccttgcggtattcctcctgggacatgtcctcggtgccttttacgcccatggcggcagcaatatccttatactttgtgcccgtggcatccgcgttatattccattacggcaggaagcaggatcgcgttggcaatgccgtgaggcgtatcgtattttgcgcccagggtatgagccatggagtgaacgattccaagtccgacgttggagaatcccatgcctgccacatactgtccaagcgccatgtcggcacggccttctggcgtgttctctacagcggcccgaagagagcgggcaatgatttcaatggatttgatgtggaacatatcggaaagttcccatgcgcctgcggtaatgtatccttcgatggcatgagtcagggcatccattccggtggaggctgtcaggccctttggcatgctggacatcatatccgggtcaatgatggcaacgacagggatgtcatggggatctacgcatacgaatttgcggctcttttctacgtcggtaatgacatagttgatggtaacctcggcagcagtgccggcagtggtaggaaccgcgatgatcggaactgacttattcttagtatcggccgcgccttccaggcttcttacatcctcatgctccggattggcaatgatgatgccgatggccttggcggtatccatagaagagccgccaccgatggcgatcaagtagtccgcgccggagttcttgaaggcctgtacgccggtctgcacgttttcaatggtaggatttggcttgatattggaataaagctcatattccaggccgttcgcgtccagtacatccagcaccttctgggtaacgttgaatttgaccagatccggatcagaacatacaaaagccttctggaagcctctggcctttgcctctgtggcgatatcatggatggcgcccgcgccgtgataggatgtttcattcaagacgaatctgtttgacataagtatctctccttttctctgtgaaaattaactttgttataattataacgatctattggcgccgagaaaagttacaaaaaaagcaagatgtcacaaaagtgacaacttgcagaaagtgtaacatccattcccttaattcagatccgtcagcagttcctccaaaggctccggtagagccaggatcagaagatcagccatttcctcgggctctaaatccatatcttttctggcccattccacggtcatgtagatagagccgcggcagtacatctctaacaagaactgaatctttttatccaggagctttccggtcttgcgcctgatgatgccggtgtaaaattcaaggatgcattcataatcatactggagcaaagagttataatcctgggactggaacgcggaggtgaagaagcagcgctcattctggataaaatggaactttttgaccagcccctcccggagagtgaggctgacgcccatctggcggaaagacttgtcggccagctgctcgaaatgccagttcaccaggtcatacttatccttaaaattgcggtagaaagtctggcgcgtcatctcgctgttttccacgatctccttgacggtaatcttatccaggggcttggcctccataagttttttcatagaggcaacgaacttgtttctggttttttcgctattatccattccatctactcctgtcgtaaaaaggtatccgattactgctgtatagtgtttattataaaagttcccggagaaaatcacaatcatattttggaaaaaactgttcattgaaaacgaacatgtgttctgatatgctttgggatatagaaggggtgaaaaaatggaagagaaaaccgtatatcatattgacgtgaattctgcgtacctaagctgggaggcggtctaccgcctgaagttcctgggagcccgcacagacctgcgccggattccttctgccattggcggggatatcagccagaggcatgggattatcctggcaaagtccatccctgcgaaaagatataagatccatacaggagaacccgttccccaggcaaggcagaaatgtcccgatcttctgatcgcgccgcccaattatggcctgtatgaaaggtgttccagggcatttgtgaagatcttaaaagaatactccccggatgtggagcaatattccatcgatgaagtatatatggatatgacgcagaccatccatctgtatggcgatcccgtccagacggcattcgatatcaaggaccggataaaaaaggaactgggatttaccgtgaatgtgggcatctcaaccaacaaggttctggccaagatggcctcggagtttaggaagccggaccgggtgcatacgctgtacccgccggagattcccaggaagatgtggcctttgccggtggaggaacttttctttgtcggaaaggccagcgcgggcaaattaagaaaacttgggattgagaccataggggaactggcagaagcggacccggaactattaaggcggcatctgaagtcccacggggaagtcatctggaactttgccaatggccgggatttttccgtggtgcagcccgtggaagcgccgaacaaaggctatggcaacagcacgaccatcagttttgacgtaaaggatgcggccacggctaagatcgtgctgcttggcttggcggaaacgctggggatgcgtatccggaaggatgaggcagagatacaggtggtgagccttgacatctgcgactgtgaattcaaccggatctcccaccagagggtgcttgagaatcccacggatattacgaaggaaatctaccaggcggcagccaggcttctggatgaggcctggaaccagatgccgatccgcaagctgggcatccataccggcaaggtgggggaggccgggtggagccggcagatgagcctgtttgattccggagactatctgaaggaaaagagatgggatagaaccatcgaccatatccgctacaggcatgggatggatgcgataaagcgggcggtgttcctgggacagcccaggattgaccatctctcagggggaatttccagggaaaagagaagcgtagactatgcaaagatcaagattgattagaaaggaaaggggcgaagagcatggcattcggagtcggagtaaataccgggaaggcagatggagggaagattaagggaaggcaggaggcagtcgcctgcggctgctggttcaccagtcagggaaacacgcttccaaagtatatcaaataccaggacgaggaagggatgatccggggaatatcagacatagaagtgctatattcccagaagcagaattactgcggaattcccatggtggagtacgtctgccgcggagtgacgcaagggatgcggcgcggctttaggctgttctttcatctggaagaatgtatattcaagattgtatgggagtgacattgcgtgcagccagaagcccggttttttgaggtcaatgacaaaaagccgagttcacagaataaacatacatttaccacatacttttcaaaaactgcccttatactgttaagaactattatgattgacaggaggaagcgcattgattgaagtaaagaatctaaccaaacgttatggaaagcacctggccgtggatgacttaagcttcaccgtggaaaaaggccagatctatggattcctggggccaaatggcgcgggcaagtccacgacgatgaacattatgaccggatatctgggagccacatcaggcgagatcctgataaatggacatgatattctaagagagccccaggaggcgaaaaagtgcatcggctatctgccggaacagccgcccctctatatggaaatgaccgtatgggagtatctgaactttgcggctgaattaaagaaaattcccaaagatgaagtaaaaaaacaaatagagaaggttgcaaagcttacaaggcttgaggaggtgcagaaccgcctgatccataatctgtccaaaggatacaagcagagagtgggccttgcccaggcaatcctgggattcccggagatcatcattctggatgagcctacggtaggtctggatcctaagcagatcatagaaatccgggaactgatccgtacgctggccaagaatcacacggtaatcctgagttcccatattctggcggaagtccgggaagtctgtgactatatcatgattattgccaagggaaagctggtagccagcgacacgccagagaatctggagaatcttatgagcggcacaggccatgtggaactggaggctaagacatccatggagaaggcaagggctatcctaaaggagattccccaaatcagcaaggccgagtaccaggaagagacgaaagagagcgttaccgtgcggatagagtcagaagggcagtcagacatccgggagcagttattctttgcgttcgcgaaggaagggattccgcttctgactctgaagctgaacaagtccacgctggaagacatcttccttgaactgacgcaaggggataaagcgcaaggcagcgattctgcggaaagccaggacttccaggaaaatatagaagacagcaaggaggaagagacgaatgagagcgatatataaaagagaactaggcgcctattttcattccatgatcggctatgtatttattgcatttctggtggcatttacaggaatttactttatggcgtacaacctgaattatgggtatccatatttttcttatgtcttatcgggaattctttttgtgttcatgatagcgattcccattcttacgatgagaagtttcgcggaggacaaaaagagcaagacagaccagctgcttttgacgtcgccggtcagcctgtttaagatcgtgatgggcaaatacctggcgatggcctccattctggcaatcccgtgcgtaatatatctgatattcccatggattatcaaggcccagggcacggcgtatattctggttgattacttgtccatcctgatgttctttctgctgggatgcgtctacatctccatcggcatgttcatctcgtctttgacggagagccagattatcgcggcgatcgggaccttcggaatcctggttcttctgtacttatggaatgggatcctggatttccttccttcctcagcgctggcaaatgtaatcggagccatcctgatcctgacccttgtggcggcaggaatctggcagatgacgaagaactggatgatcagcggcgcgctggaggctgtggtcatcgcagggggcgtgatttcctatatcgtcaaatcaagcctgtgggagaatgccctgtcacagattctgggaagactggatctgacaaaggcctttgccagtatcgcgtccgaccgtctgctggacatcagcggcattgtcctgtacttgtcgctgattggcatattcatctttttaactatgcagatgatacagaaaagacgttggagttaggaggggcttatgttagaaaagataaaaaagacatttcagaatcggacttccaggaacggcagttacagcgtaggactgatcgcgctggtcgtaggcattgtagtggttatcaatctgatcgccgcccagctgccggagaatatccgcaagatagacatcagcgacaacaagatttatgagatatccaagacgagcaaaaagatattggaaaaattggatcataaagtcactttcaaagtatttgcagaaaaagattccgcggatgaaagaatccggacatttcttaagaagtatgccgctctttcagatcagatcaaggtggaatgggtagacccggtgctccatccttctgcactcaaggacaacaatgtagaagccaatacgatactgatttcctgcaaagataccggaaagaccacgacggtggcctttgataagatcatcgtggtggatgaatactcttactatacgactggaagcgctaccgagtcagagtttgacggggaagggcagcttaccagcgccattcattatgtgaccagcgatacccagaaaaagatgtattataccacgggacacggggagagcacattttcctcctcggtatcagaacttctggataagaataatatgtcggaggaagaagtgaatcttctgatggccggaaaggtaccagatgactgcgaccttctgttcctctacgggccggtcaaagatattacagaagaagaaagcacaatgcttgcggactacatgtccaaaggcggaaaggtatttctgattctgggagatgcaaaagaggatacgccgaatctgaagaaattccttgcggagtatggcatggagcaggcggacgggtacattgcggatatgcagaggtgctaccaggggaactattactatatcttcccggaaatcagcgcatccggcgatatggcggaaggactggatacggacatggtgcttctttccaatgcccacgggatgaatctgacggatccggcaagggataccatttccgtgacgccgtttatgagtacttcctccaatgcatatgcggtgacccaggaggcgcagaaggaaggatcctatacgctgggggcggttgccacggaaagcatttcgtctgatgaaggaagcgatgcacacaaggatgaaagcgccgaagatgaaagcacatccggcagcagcggggaggaaaagcaggcaaggctaaccgtcatatccgcggaaagcctgattgatgcgcagattacggacacatttacaacgctggagaatctggacctattcatgaacgcagtgtcagccaactttgatgacgtgcagaatgtggcaattgagccaaagagcctggaggtaacttataataccatgcagcatgccggcctcatcagccttctattgatattcggcatcccgtttatcatactggtctatggattggtaaaatggtggaagagaagaaaagcatagggagaaggtggggcgttatgaagcagaaaaagacgatggtaatattaatcctgatcctggcagtcctggcctccatatatggcggcctgaaggcctggggcaagaaggctgccgaaaaagaagcaggagcggcagcagaaaagatcacggtcacggatcttaagaatctgtcctcattttcttattcgaatggccaggagaccatgagttttgtcaaggaagatggaacctggaaactggaagatgataaagaaatccggctgaaccagagtaccgtagaaagtatcggggaggccgccgcggaccttgcggcagtccgggagttaaaagagccggatgatctggatgattatggccttacgaagccttcttatacgattgacctgacgacagaagacggcgataaggaaaccttgtatgtaggggatgcggcgggagaggattactatgccatgacagaggggacgcagaaagtatataccatttccagcagcctggtatccgccctccagtttgacctgtctggcctggcccagctggatgtggtgccggctatcagcagcggcagtctgaagaaagtaaagatcacggaaaatggggagacgacgacctacaaagaagaggatgaactggcggaactggctggaggattcggagcattgaccctgaccgaatgtgcggactatcatgtgacggacgaagaattaagcgcctatgggctggacgaggcaagccgcgtcacggcagaggcggcctataaagatgcccagtcagggaaaaagaaaacatttaccgtctacatcggcaaaatgagtgaagatggcgccagcagatatgtaatggtgaaagattccaagatggcctataaagtaagccaggatgtggtatccaacatgatcactgtgagtcaggaggacgcaaaagaataaaaaatactggataataaaatcccttcctgtataataaaggagagagaatacacgggagggagaacattgaggaaagatacaaccagcaccatcaagcgcgcggagcgctttcagattatactaattggagaaggaatactggtaggcggcatcggagggctggtggtgcttctgtaccggatgtgtctggaatacgccggcaaatggctgaatatgattctggaatatgccaggcaaagcccgataagaattgccgcatggttcctgatcctgattgcgatggcgtggcttgtcgggaaactggtgaactatgagccgatgatatccgggagcggcatccctcaattggagggagagatggtaggcaagctggagcagaaatggtggaaggtccttcctgccaagtttgcaggaggattcttatgcctgctgggaggacttgcgctgggaagggaaggcccgtccatccagttgggcgctatggtaggaaaaggaatctcccgggggatggacagagggaagacagaggaaaggttcctcctgacctgcggggccagcgccggcctttcagctgcgttccatgcgccgcttgccggggtcatgttttcgctggaagaagtgcacaagaacttttccgtgtccgtgcttctgtcggtcatgacggcctcgctgacggcggatttcctgtcttctaccgttttgggcatagattctgtcttccagtttgacattgtaaaggccctgccacaggagtattactggatgatcgtggcgcttggaatcgttcttggcgctacgggagcgttctataactggtttacgctgaaagtccagtccctttataacaatgccaaatttttaaacactacgacaaagctcattattccgtttgtctgtgccggaattctcggatttacggcgccagaacttctgggaagcggacatgccttgattgaatatcttaccaatacggatgtgatgctggggacggtcctgtttatcctgataggcagattcctcttctcagccgtcagtttcggctcaggcgccccgggaggcatcttctttccgctgctggtgctgggaggattcatcggaggaaccttcgccaccgtaggggtgcagttcttcggactggatgcaatgtatatcaacaacttcgtactgcttgccatggccggatactttgcggcgatcgtgcgcgcgccccttaccgggatcatcctgatctttgagatgaccggctccctgagccagatgctgtccctgtccatcgtatccatcgtggcctatattgtggctacgcttttaaagtccaagccaatctatgaaagcctgctggaacgcctgctggagcggcaaggccagaaagtatccaaagaccatggccagaaagtactgacaaacttcgtggtgcgccagggctccaggctggaagatacgacgatcagcgagattgaatggcccaacaactgcctgcttgtggcaatccagaggggagcagatgaaatcattcccaaaggcaggaccaggctgcaggtaggagacgtgatcgtaaccatgacggacgaacgagacatcagcaccgtgcatgaccgaatggaacgactgtgcagcgatatgttctaggggagtgtttatagaaaaatacaattctataatattttctccttgcaatcgagaaatcggtgtgctaacatataaaacaaattttaaacaataaagcgatgaaagagactctgttctttggaacttgacaggaatgaggcgtcaccgactgagagcgccgcttgaggaataagaacaatagggaacactctggagcagaccgtctgaacttaagtaggccggtacgtaggcacacgttacgtgcaagagaggagccaagtcacataaaaagtcacaaggctcaaagcgggtggtaccgcggatagcaaagaagatatccgtcccgggagagatacaaacagtatccctccttgggacggtttttttcgcgttggcaatgaggactgcgttccaaaaccaacattgcaattcgtcccggaaaagaaaaggaggacaaaatggaatatttaacaggagtaagacacaaggacactttagaaatcagcgaattacggaagcaggcgcagccaggccagacagtcaaagtaaacggcgcggtgcatgccatccggaatatggggacagtggcattcgtcatcctgagaaaacgggaggggcttcttcagggagtatacgaagagggcaccgcaaagtttgacttgaaagatatcaaggaggctgccacaatagaggtagaaggcgtgcttgaagaaaatgaaaaggctccgggcggcatagagatacggatggagaatctgaagatcttaagccagcccaaggctgagatgatgccgctggccatttctaagtggaagctgaacacgtctttggaagcaaagttaaattaccgttccatttctcttagaaacataagagagcgtgctaaattcagaatccaggaaggattgacgcgtgctttccgggacttcctttacagtcagggatttacggagattcatacgccaaagattggagccaaaggcgcggaaggcggcgcgaatatcttcaagctggaatatttccacaggcctgcggttcttgctcagagcccccagttctataagcagatgatggtaggcgtattcgacagagtatttgagacagccccggtattccgggcagagaagcacaataccaagcgtcacctgaatgaatacaccagcctggactttgagatgggctatatcgatggattcgaggatattatggcgatggagactgggtatctgcaatatgccatggaactgctgaaaaaagattatgcgcaagaactcaagatccttggcatcacgcttccagaggtggagaagattccagcggtaaaattcagcgatattaaagaaaaggtgtctgagaagtatggtcataagatgaggaatccttttgacctggagccggaagaagagcagctgatcagccagtatgccaaggaagaatggggcagcgactttgtgttcgtgacacattacccgtccaagaagcgccccttctatgcgatggatgatccaaaggatcccagatatacgctgagttttgatctgctgttcagaggaatggaaattacgacaggcgggcagcgcattcacgattatgagatgctggctgagaagatcaaggcaaggggcatgtcccaggaaggaatggagcagtacctggatactttcaagcatggcatgccgccgcacggaggaatcggcattggcttggagcgtctaaccatgaaactgattggggaggacaatgtaagagagactacgctcttcccaagagacttgagcaggctggagccataagagaggcttcagaggtataggagaggaaaaatatgtttggcagaaagtgtacgttatgcggggggaagcttgacggaagagggatctgtacagaatgcggcttggataataataaggcggataagaattataagattaatgagagcagctgcgacgatatgccgcttacgcatgtccatgaggagccaaaaaggcagaaggcaaagcctcggcaagagaatataaaacagcgggctcaagggatgcaaagccagaatacgcagagccggaatccacggcaggatcaaggacagcatgaggtaccatatggctggcagcctcagagaatggaggagacgcagcagaggaagatcagcagccggcaggccgcagaagccaaaaaacagaacaaaggcaagaagattttcacgatccttacgattattcttacggttgcgggaatcttgattggcatagcaaaagaccgaagcagcgagacattggagccatcgggaacggatgcggcagataattatgatccttacgcctatgtgacgagagaactctccgagcaaggcgaatctgtagaatatagcctgacatccgggaattatattgtaggggtgcatattccggaaggaacctatgaggcatttccacaggatgattttgacgcagtcagggtagatgacgatgaaaacgggatctacttgtttgaatatacacaaggagaaacggacacgattaaggatatccgtctgtatgagggcgcgaccctgacgatcacgagcaaggatatcatcaccttgaaatccaagaatgcccaggacttagatatggcagtcgaggcgaaccctctgacagaaggagttgaactggcatccggcgaaaccaagaccgcaggggtggatttcgctccgggcatctacgatgtggaattgacaagcggctatggaatcgtagaagtacaaatctatggtgaaggcggacaagaatgggactatgtggggcttgatctcgaagaagatggaatggatggaagttccttccgatatctggtgcttccggaacaggcaaccatattctgcaaagatgacctctccgtgacactgacgccaagcgaaaagatagagtcaacagattatttcagtttttatcaatgatagaaggaggcagttatggcacataaaatatcagacgagaccattgaatatgtaggaattctggcaaaactcgaattgtcgggccaggagaaggaagatgcgaaggccgatatggagaaaatgctggattatatagatacgttaaatgaactggacacggaagggatagaaccgatgtcccatgtatttcctattaaaaacgtattccgcgaagatgtggtgacgaacgaggacggaagcaaggatacgctggccaatgcgccgcttcagaagaacaacagtttcaaagtaccaaagacaatcggttaggagggtgcggatacaatgaatattatgagcatgacagcagtggaaataggaaaaaagatcagatcgaaagaaatatcggtagcagaggccgtaaaagcatctttgagccagatagaaaaggcagaggaaaagattcacagttttgtgacggttgacagggaaggcgccctcaaacgtgcggaaaagatccagaagcagctggaggaaggcagccttacaggccctctggcgggagtgccagtggcgatcaaggataatctttgtaccgaggatatgcttactacctgcagttctaagattctggaaaactttaagcccacatatacagcagaggcagtcaggaatctggaaaaggcgggggcagtgatcattggcaagaccaatatggatgaatttgccatgggaagtacgacagagacctcttattttggagagaccaggaatccatggaatctaaagcatgtaccgggcggctcctccggcggctcctgcacggcggtagcagcggaagaatgcgcgtttgcgcttggtactgataccggcgggagcattcgccagcccagttcctattgcggcgttgtggggatcaagcctacgtatggcacggtatcccgttatggtctggtggcctacggctcatctctggaccaggttgggccgatcgcgaaggatgtgacggactgcgcgacgattctggaagcgatcgcttctcatgacccgaaggatagcacgtcgattgaccggaacacatatgcctatccgggaagaaaagaaggaatcaagggctatgattttaccggcgctctggtggatgatgtgaaggggatgagaattggcatcccacaggattattttggaaaagggctggatcaggaagtcaaggaacggattctgagcgcggtaaaagtattggaggaaaaaggcgcggttgtggaggaattcgatctcagccttgtgcagtatgcggttcctgcctattacgtgatcgcttcagcggaggcaagttccaatctgtcccgctttgacggagtgaaatatggataccgcacggaggaatacaaaggacttcataatatgtacaaaaaaacccgctcggagggatttggctccgaggtaaaacgaaggatcatgctgggttcctttgcgcttagttccggctattatgacgcttattatctgaaggcattgaagacaaaggctcttattaaacaagcgtttgacaaggcttttgagaaatacgatgtgattgtggcgccagctgcgcctacaacagcgccggaattaggaaagagcctgagcgatccgatgaaaatgtatctggcggatgtctatactgtttccgctaacctggccggccttcctggaatcagcgtaccggtggggatggattcaaaggggcttcccgtgggaatgcagctgcttggcaactgctttgaggagcataagatccttcgggcagcatacgcatacgaacagacaaggccttatgaaaggcctggctttgtaaaggacatggcagggcaggaagctgcccgggcggatgaaagcaagaaagggggcagataatcatgaccagacagtatgaaacggtgatcggactggaagtccatgtggaattagcaactaagaccaagatcttctgctcctgcagcacgcagttcgggggcgcgcccaatacgcacacctgcccggtgtgtactggcatgccggggtctcttccggttctgaacaggcaggtggtagagtatgctatggcaatcggccttgccaccaactgcgagatagccagggaatgcaaatttgaccgcaagaattatttctatccggacaatccgcagaactaccagatatcccagctgtatctgccgattgcaagaaacggatatgtggagatcgaagcaggggacattaagaaaaaggtacgcatccatgagatgcacatggaagaagacgcaggaaaactgatccacgacgaatgggatgacacctcgctggtggattataaccgaagcggcgtcccgctggtggagatcgtatccgagccggatatgcgctcagcggaagaggtgatcgcttacctggagaaactgcgcaccatcatccagtatctgggggcatccgactgcaaactgcaggaaggctccatgagagcggacgtcaacctgtctgtccgggaagtcggcagagaggaatttggcacccggacggagatgaagaatctgaactcctttaaggccatagccagggcgatcgaaggcgaacgccggcgccagatagaacttctggaagaagggaaagaagtagtccaggaaacacgcaggtgggatgacaacaaagaggcctcctatgccatgcgttccaaagaagacgcgaaggattaccgctattttccagaacccgacctggttcccgtgaccatcagcgatgaatggatcgaggaagtaagatcaagacagccggaactgcgggcagagaaactagaaagatataggaaggaatttgatattcctcagtatgatgcggagattatcacaagttccaagcatatggcggatatcttcgaagcggccacggctatctgcaaaaagccaaagaaagtatccaactggctgatggttgagaccctccgcctcctgaaggagcatgatatgcagccggaagatatccggttctcgccggagaatctcgcagcgctgattgaacttgccgacgcgggaaccatcaacagttccgtggcaaaagaggtatttgaaaagatatttgaagaggacgtagatccaaaagactacgtagagaagcacggacttaagacggtgaatgacgaaggcgcgcttatggaagtgctgacgcaggtgatcgcagagaatccgaaggctgtcgctgattttaagaacgggaaagaaaaagccctgggagccctcgtgggacagacgatgaaggccatgaaaggcaaggcggatccgggactggcaagccagaagttaagagagatgttaagttagtattagacagaagcggctgccatgtgttacaattcttgagtaatatcatggaatataaaatacgatgaatagaaaaggagaagtcatatgggaggtttttttggcgtagcgtcaaagaatgattgcgtattagaacttttttatggagtagattatcactcgcatcttggaaccagacgaggaggtatggcaacacacggcaaggctggattcaaccgtgcgatccacaacattgagaactcgccgttccgtacgaaattcgagcgtgatgtggaagagatggagggaaatcttggaatcggctgtatctcggactttgagccgcagcccctgctgatacaatcccatcttggcagttttgccatcacgacggtcggcaagatcaacaattttgatgaattgctggggcgtgtttataaggatggccattctcatttccaggagatgagcggcgggcaggtcaatgccacggaactggtggcatcccttatctgtaagaagccaacgattgtggagggaatccagtatgtacaggagatcatagacggctccatgacgcttctgctcatgacagaggacgggctatacgccgcgagggaccgctatggaaggactccgcttgctatcgggcataaagaagacgcgtactgcgtttcttttgaaagctttgcttatatcaatctgggctattcggactataaagaactaggcccaggggagatcgcatttatcactccggaaggggtggaaaccctgagcgctccaaaagaagagatgaagatatgctcctttttgtgggtatactatggatatccgacctcctcatatgagggagtcaatgtagaagagatgcgctacaaatgcgggagcatgctggcaaaaagagatggagattccgtacatcccgacgtgatcgccggcgtgccggattctggtatcgcgcacgcgatcggatacgccaatgaggcaggcattccatatgcaaggcctttcattaagtatacgcctacctggccgcggtcatttatgccgcagaaccagagccagcgtaatctgatcgccaggatgaagctgattccggtaccggccctgatcgaggataagaaactattgttgatcgacgattccatcgtgcgtggaacccagcttcgggagactacagaattcctgtacaatagcggggcaaaagaagtgcatgtccgtccggcgtgcccgcctcttctatacggctgcaagtatctgaacttttcacgttccaagtcagaattggaactgataacgagacgtgtcataaaggaacaagaaggagaagactgccctcaggaagtattggacgagtatgcggatccttgctcctgccgctacgcaaagctgatcgaggagatccgcaagcggcagaattttacgacgctgcgctatcacaggctggatgacctgatcgcatccattggcatcgagccgtgcaagttatgtacttattgctttgatggaaaagaatagaagaataagaaatattttaagggagagcaatagaaggctctccctttttaacgcgtgatcagttatttgctaatggcataggtcaatatataatcatccatgacaaacccatttccgatgtccgccacctgctcatccgtaatcttaaatcccagatgatcatagatggccagggtattgtcattgtgcttattacaggttaggtagatcttagaaaggcctctttcacggcaaagatttacaaggaactggaaggcttctgttgccagatggcatccgcggaattcctttttgacatacagcttgcttaggaaaagcgcgtccgcttcctggtgaatgccggtatagcctgccatggcatgcgaacgatagatctgaaaatattcatagccgtcatgttctatctgcgctttgatggcaggataggattggaacttatctaccatatagtccacctgctccttgccgatgattggcgtaaaatgctgatgccatatctcttccgctaatatggcgatgtcctgtatctcgctgtcagacttggcgggacgtatttctgtcgtgttcatattcttggctcctgttctttagaatagttttataaataagtcaattctcttctgctattataagtgatataataaaaagatacaataatgaattcagaggtcggaggaaggcaatggacaggtttgtgtcattagagggcgtgaaaaagatatacaatatgggcgaggttaagatcatggccgccgcgggaatcgacttccagatcaagaagggcgaattcgcggtagtggtagggccaagcggcgcgggcaagaccacggtccttaacattctgggggggatggacacggcgacggaaggaaaggtcctggtggacggacaggatattgcgacctattcccagaagcagcttaccgcgtaccgaagggatgacattggatttgtattccagttctacaatctgatccccaacctgaccgcgcttgagaatgtggaactggcgctgcagatatgcaaggatccgatggacgcggcagacgtactggaagaagtgggattgggggagcggctgaacaactttccggcacagctctccggaggggagcagcaaagagtatcgatcgccagggctttggcgaagaatccgaagcttctgctgtgcgacgagcctacaggggcgctggattataatacaggaaaggctattcttaaactgctgcaggatacctgccgcaacaagggaatgacggtcatactcattacgcataattcagcgatagcgccgatggcggaccgcgtgataaagatcaagaacggaaaagtttcggacattatagagaataaatatcctgtatcggttgagacgatagagtggtagaggtggcgcatgggaacaaagtctacgcgaaaagatttttatatggagataagaaagagttcagggcgttttatatcaatcctgtttattgtggcgctcggagttgctttcttttctgggatacgctcctccgagccgtcaatgcggataaccggagatgcatatttcgatggcgcgaatctttttgatattaagacggtaagcacgctgggtattacgaaagatgatatccgggcgcttcaagaggtagacaatgtggcgaaggccgaaggctcatacagcgcggatttcctaagcaatacggaagatgagcagtatgtccttcacgtgatggcgctgcaaaaagatatgaatgaggcggcggtgacggatggcaggcttccaaagaagattggggaatgcctggcggacgacgagatgggatacaaggtgggcgataagattacgctaaagtcgggaaccagcgatccggtctcagatacgttaaagacagaggagcttacggtagtcggaaccggaagcagcccttgctatatctcctttggcagaggcagcgccaccatcgggaccggaagcatagatggattcctgatcgtcccggaacagacgtttgacatgccggcctatacggaagcctatgtgcaggtggcaggggcaaaggaattgacgacctatacgcaagcctatgataaaaagatcgaagaagtcatggatgggatagaagacattaccggggaccggggcaagatacgaaggcagcagttgctggatgatgccaatgccgaacttgacaaagccaaggatgaacttgcgaaaggaaaagaagaatctgaccagaaactaggcgatgcggccaatgctattgccgatggcgagcagcagttaggcgatgcccgggcgaagatagaggacggcaagagccagattgccgatgcaaaggcaaccttgaattccaagcagaaggaactggacaatgcaaaggcagagtatgaggctggcttggcaaagtttcaggagggaaaggccgcctatgagcagggcgcggcagagtttgccgcaggcaagccggcggcgcaggaacagatccggcagggagaagaagggctggctgtgttccgccagcagctggatcagggatggagcggatataaccagcttctggagaacataaaagggatggaggacaatcccatggatccatcggagcccggatatgatgaatggctccagaccttgggaggactaaaggagcaggcagatgcgacaaatcagcagcttagcgcgcaggaagaagaatatgccaagcagtctgccaaacttgaaggggcgaaaaagcagttaagcgatggcgagcagaaacttcaggatacgaaggccgctctggatggcagcgaacagcagcttagccaggcctctgcccagataaagtcggggcaggagcagattgatgccggatggcaggaactccattcgaaggaggctgcgctgaccgatggcgagaatgagctgaacgctaaggctgcggaactggaagatgccaagaaggaatatgaagacggcaaggccaaagccgaggccgagatagaagacggcgagaagaagatcagcgatgcggaaagggagattgccgatatcgagaagcccaaatggttcgtctacgacagaagttctctgccggagttctccggatacggagagaatgctgaccggatgcgggccataggaaaggtgttcccggtcatcttctttctggtagccgcgctgatcagccttaccagcatgacccgcatggtggaggagcagcgcaccgcgatcggaaccatgaaggcgctgggctatgacaaattcgccattgcgtccaaatatctgggctacgcccttctggcgacggtgggcggaagcgtgatcggcgtgctggtaggtgaaaagatccttcccttcatcattatctatgcgtacgagattatgtatcaccatatcccgaagatattggtgccatataactggcaatatgcggcaatcgcttcctttgcggcgatcatctgtaccatggcggctacattcctggcttgctacagggagctggacgcgcagccagcggaattgatgcgtccgccatcgccgaagaatggaaagcgggtatttctggaacggataaggataatatggaagcatctgaactttacatggaagtctaccgtaaggaatctgatgcgatataaaaagcgtttcttcatgacgatattcgggatcggaggctgtatggccctgatgctggttggttttgggcttaaggattccatctttgatatcgcggacatccagtatgatgatatccaggtatatgacggaagcatctatcttcaggagaatctgacggatgagcagaagcaggatttaaggggattccttaaaaaagacaaggacgtgcagcgctttattgatgctaatatgcagagtgtgacgctggtcaatggcaagaaggagcgggagacctatgaatgcgtattggaagatccgggaaaaatggatcagtacatccatctgcgggaccgcaagaccaaggaagcctacgaactatcggatgagggggcgatcataagcgagaagaccgccaaactgctggatgtaaaagtgggggacagcgtctacatcaaggatgagaaggatggaaataaagaagtaaagatcgagcatatctgtgagaattatatggggcactatctctacatgacgccaaaatattatgagaaagtgtacaatgagaagccggattataacagcatattctttgccgccaaggattcttatacgaagaagcagttggagaaggccggagaaaagattgtggcggaggatgcggtgctcagtgttggctatatgcatgacatagagaagcagctggacgatatgctaaagagtttgaacctggtaatcgttgtcctcatcatctcggcaggaatgctggcctttgtcgtgctttataatctgaataatattaatattacggaaaggcagagggagctggccacgcttaaagtgctgggattctacaatccggaagtggcagtctatgtgtacagggaaaatatcatcctgacatttgtgggagcggctgtcggggcagttcttggaaggattctccatttgttcgtgatccagacggtagaagtggacgccgccatgttcggacgcaacatcaatctgcccagctatttgtacagcctggcgtttaccgtggcgttttcctttatcgtcaatggagtgatgtattttaaactccggaagatcgatatggttgagtcattaaagagcgttgaataggattatattttaaaaggactcttaaaagaaaatttatgttttcacggaaattgttagcactctttttaaaagagtgctaattttctattgacttttgaatttctccgtattatcataactgatagataatcaagcgggagatagccgcaaaaaatattacaaagaattaggagtgataaagatggcagcaaaaaaaggcagtttatctatcagcagtgaaaacatatttccaattataaagaaatgggtgtactcagaccatgacattttcgttcgcgaaatggtatccaatggatgcgacgcgatcacgaaacttaagaagctggatatgatgggggaataccagcttccggatggctataagcccagcatcaagattgaggtaaatccagaagaaaagacgctgaagttcacagacaatggtatcggaatgacggctgacgaggtagaggaatatattacccagatcgcgttctccggagctacagagttcctggaaaagtataaggacaagacgacggaagacgatatgatcggccatttcggattgggattctattcagccttcatggtagcggatgaagtgcatattgacacgctgtcttataaggaaggcgctactccggttcactgggtaagcaatggcggcacggaatatgagatggaagatggcaccaaggcagaggtaggatccaccatgacgctgtacctgaatgaagacagcctggaatttgccaatgagtaccgtgtaagagaagtcattgagaaatactgttccttcatgccggttgagatcttcctttccaaggaaaatgcggaaccggagtatgagactatcgatgaggcggatttaaaagaagatgatgtagtcatcgagcatattcacgaagatgccaagatggaagaaaaggaaaatgaagacggcgaaaaggaaatggtggaagtagaaccggctaaggaaaaggtaaagatccagaagcgtccggtatccttaagcgacattcagcctctgtggacgaagcatccgaatgaatgcacggatgaggactatctggaattctaccgcaaggtattcctggactataaagagcctctgttctggatccacctgaatatggactatccatttaatttaaagggaatcttatacttcccaagaatcaacaccgaatatgattctatagaaggaaccatcaaactgtataacaaccaggtattcatcgccgataatatcaaggaagtcataccggaattcctgatggtattaaagggagtcatcgactgcccggaccttccgctgaacgtatccagaagcgcgctgcagaatgacggatttgtcaataagatagcggactatatctccaagaaagtggcggataagctgtccggaatgtgtaagacaaagagagaggattatgagaaatactgggacagcatcagcccgtttatcaaattcggatgcctcaaagacgagaaattctgcgataagatgaaggatgcaatcctctttaagaatattgatcacaaatatctgacgctgaaagattgtatagaagaaaacggcggagaggtagttgagccaaatgacaagaaggaagaagagaatactgatggcagcgatgagaacaaagtagaagagattaagacgacgatctactatgttaccgatgaagtgcagcagagccagtacatcaacctgttcaagagtcaaggacaggatgcggtaatactgggacataacattgattctccatttattacgcagctggagcagcgaaacccagccatccgcttccagaggatcgacgctgacgtgacggataccattaaggaagaagtggcggaagaagagaaagaagaatttaagaagacctctgacagcctgattgaaatcttccgcaaggaactggaaaatgacaagctggatgtaaagatcgagaaactcaaggatgacaatatggcagccatgatcactctgtcagagcagaaccgccgtatgcaggaaatgatgaagatgtacggcatggacggaatgaatatgggcggagagagcaccctgatcctgaatgcgaaccatccgctggtacagtacgtggtagagcacaaagacaacgagaataccagcatcatctgcaagcagctctatgatctggcaatgctggcgcacaagccgttaagcccggaagagatgacggcatttgtaaagagaagcaatgagatcatgatgcttctgacgaagtaggagaatagaattacagtctttgactatttttctaaacgataagagtctgagacagtcggcttaattaagccttctgcctcagactcttacatttcattttactttttgtatttgccaaatgctttttcttcatccagatgtacatccttaaaaaacatgatcagccatacaataaatgcgatcactcccatatactgcgatataaaatacgaaaggatagcgccaattcccataatgcccgaccagattaaaaaggcatttctctggtccctgctcatcctatcctggtcatacagttctctttgatatttgggaatcgtattaaagccgctgatcaatatcgcggcccttcccttcaaaatcgtaaacagcaaagccaaaaacaaaaacagcaaacaagaaatccccaaagtaataaatccaacattcataagaacacccctaactttgtattttatctatactaaacacaatgaatttcaagcctttttaacgaatgaaatctatgtaatatcacacaatcccggcaaacccccataactttccgcccgcactctacgtagaattgccaacaaattgacgcaagcccgggaggggaggagggaattctgtaggtaagcgtttgagacgcagaatccatgcctgagatgttgggacgcaaaagaggagtcagccgacgactctttcgcggccttacagatcagtgcattagtcggagtctcagaaagcgtcggaagaatcccctcctcccctcccgggcgcccgccaatcaccacaattcctacaactcccgccagttccccagcattttccctacataagcatcccattcccgctccagcgtcttatccatggtaaaggtgtgcatggaggtgccggtgatgcattgcagcgttgtcccgtcgtagtggaagttcaggtacaagccctgaatatcttcggcccggcaggcgccaatctggtgcttctccaggaaagcggcaaagttttccggggccagcgacaggacaatcttgaagcttagcggggtgcgcctgcctcgtatgatggcaaagcaaagctcgcgcacctccttccagtaggagtgcgagcgcgttggggcgtcatcgaagaaatccttctgcaggaagccatccagggtgaatttattgaatgtggtgatctcgccttcaataaaggaaaactggtcaaaggtttccttcaggagaaggtgggccatacaggtctttgctgataatgtaataacgtccatatgaaaactccttttctaactctgattaatagtatagcataggtttgacttttatagggaaaaacagtacaatattcctatatgtgcaaatagggagaaggcagcagccgtgggagatagagacaaaagaaaagtaaaagaaattgaagagaaagatgcggtgctgcgtatcgcggtgacggtagccgtcatccttttggtcataggaatcattgttgtcgtagtaaaggttctgaatccaaaggcagatacgcagaaagggctccagaagctaaagcagatggaacagacggatgtagcgaaggtagataagaagatccagaaactggaggaagcggagcggcaggcagacgaggagtgggccagccgtccggcaagcgagaagtttgccaatgcgctcgtactgggggattccgtcacgcaggggctgtctgaattcggaatcctggacgcggcttatgtgcaggctgaccgcggaaccggggtaagcgaggcggcggataataagattgaggaacatcttgccaaagcagaagaattaaagccccaagtgctgttcctggcatacgggatgaatgatatcgaggcgaccaggggagatgccaaggcttttgccaaaacatataaggcggtgcttgaccggctgaaggaatcattgccagatacgaggatatacgtcaacagcatacttcctgtgaaacagtcagtgatcgatgagaacgaatggtatggcaacatcggcgagtataataaggcgctggaggcgctgtgcgaaaaagaggatgtgacgttcattgacaacggaagcctggtaaaggaagaatactatacggaagatggaatccatatgcagccggattactatacggaatgggtgaaccatatggcggaggtcgcaggtttgtgatgaagaagcggaagatagatttgcttaacatattaaaatatggaatggtcgtcgtatttatcgtctacatcgtatttctcctgtcacgggagggcggtaatgaggtgccggtaaagacgataagcaagaatatcctggctgttgccaacacagaagggatgaagaaggggacgacccaggatttaaagaaatattataggctgaatgccagcgattatgacggggtcatgctgtatattccggatgatgtcatgagcgtgaatgagattctggtggtcaagctaaaggacaagtcccaggccgaggccgtggaagaagccgcaagaaagcgtctggacacccagaagacaagtttcgagggctatggagcgaagcagacaaaactaattaattcggcggtactggatagcagaggctattatcttttaatggctgtttcggaggatgcggacagcatctatagggcttttaagaaaagtatgtagaagaagggttaggacggcatgttattcagtagtatcgtttttttatttacatttttaccagtgatattaatcttatattatcttgtaccaagacggctgaagaatgcggtgcttcttctttgcagtcttgttttctatgcctggggagagccggtatatatattcctgatgatattttccattatattcaactatatcagcggacttgacattgcgaggaatcttaagaaccagcgcgcggcccggggaagcctgatcttcaacctggtcgtgaaccttggaattctgggattcttcaaatacgaaggctttctgctggacagcctgaaccgcgtgctgccggtggatattccgtacagggagttagcgctgcccatcgggatctctttctataccttccagatcctttcctatattatagatgtatatcgccagaatgtgaaggcgcagaagaattttatggactttgccctgtatgtgaccatgttcccacagttgatcgcaggcccgatcgtaagatactcggatattgagaggcagctgcattccagacaagagtcctttcgcaaatttggcgacggcgccatgttctttatccggggtctggcaaagaaggtactgctggctaataccattggcatggtatttacagaagtcacttcgctggaaccggggaagatgtccgtactcagcgcatggcttgggtgcgctgcgtataccttccagatatacttcgacttcagcggatattcggatatggcaatcggacttggcaagatgttcgggttcgaattcctaaagaactttgattatccgtacatttccaaaagcattacggaattctggcgcagatggcacatttccctgagcacctggttcaaggaatatctatacatacctctggggggaaaccgggtaagcacggcgaagcatatccgcaatctgctggttgtctggttcctcacaggactatggcatggggcagcctggaactttgtggcgtggggactgtattatggaatcctgctgattattgagaagtattttcttgggagattccttgagaaactgccaggagtattgcgccatatctacagcctgcttctggtgatgatcggctgggtattcttcttcagccccggccttggaaatgcattcgggtacctgaaagtaatgttcggggcaggcgcccatggctttatcgacaaggaaggcctgtatctattctttacgaatgcaattctgtgggtagtcctggttcttggctctacccctttggtgcaccggacgtacgaaagactgcttgaacgcaaaggccaagtaagaatggctgtaggatgcatcctatatggcatgatgtttttgctgtgtgtggcatatctggtgacagagacttacaacccattcctgtattttagattttaggagacgcaatgaaacagacgagacagcgaaagaagggaaaactgtataataggaaggccatggcgatactgttcatcggttttttgatgttattctgcctggtgaacgtgcttgtcagagataaggaattctccgagaaggagaaccgcatgctggagcagaagccgaaactatcctggacgggaatcgagagcgggagatatatgaagcagtatgaatcctataagtcggaccagtttgccggaaggaacttctgggtggcatttaagacgcgggtggatctgatagccggaagacgggagtctaacggcgtgtttaagggagataagaagtatcttctggaagatatcgccaagcctaatcaggagcagatgaagcagaatctgaaggctatccgggaatttgaaaaagagtataaagatattcccatgtatatgatgctggttcccaatgccgccaatattctttcagagaggctgcctaattttgcggtaacggagaatcaggaagctacatttgatgcgatcaaaaagactttgggagataagatcacctgggtggatgcaggcaaggctctgaaagcccataagaaagaagagatctattatcatacggatcatcactggaccacgcttggggcatactatgcatatgaggaattggccaaaacgatgaagctggataccgggaaaagcccgaaactgaaagcatatgcagtgaccaatgcgtttaacggaactctgtcagccaccagcggatatgagacaggctacgaggagcctatctatatctatgttcctgagaaagaaaaagaggcgacgcaggtggtggtcagttatgtagacgaaaagaaaaagaccgccacattgtacgaccgatcgaagctgaaggaaaaggataagtacgcgttattccttggcggcaattattccatgatagatatcaggactacggcggataccacggaccggctgctggtgatcaaggattcttatgccaactgcctgatcccattcctgacgccttattacagggagataatcgttctggatccccgctactattacggcgatatcaaggaagtcatgaaggaaaataagataacaagcgtgctgtttctgtataatggaaatacttttgtagaagataacagtataagtggagtattgcaaaatggtgagactgaataaatatctaagcgacgctggcgtctgttccagaagagaggccgaccggctgatcgagagcggccaggtgagcgtggatggacaaagggctgttccgggcatgaaggttgcggatggccaggaagtaaaagtcggaaaaaaggtaataagaagcaatacggaaaaaatcgtcctggcggtgaataagcctgccgggattgtttgtacggaagatgtcagggaaaagaagaatattatccggtatctgaagtatccggtccgagtcacttatgcgggacggctggataaagattcggagggactgctgatcatgaccaatgacggggacctgatcaacgggatgatgcgcgcccggcatggtcatgagaaggaatacaaggtgacggtgaacaagccggtgacggaagatttcatcagcaagttgaaagaaggcgtcaggatcgtagataaagagaagcagcttgacgtggtcacccggccatgcaaggcggaaaaacttggaaaatataccttctcgataacgctgacccaggggctgaaccgtcagataagaaggatgtgcgaggctctcggatacaaagtggaaagactggtaagagtaaggattatgaatatagaactgggcagcctgaagccaggcgcctatcgaaaattgacagagcaggagttaaaggaattatatggacaagtcaaagaaagccagaatgcaggaattagtagaacttcttaataaggcaggacgcgcctattatcaggatgccgaagagatcatgagcaattatgagtatgaccggctgtacgatgaacttctgaagctagaagaagaacttggactcaccctgtccaacagcccgacagcgaatgtcggctacgaagtattaagcgagctgccaaaagagcggcatgaaaggcccatgctgtccctggataagacgaaggacgtcgaagaactgaaaagattcgtgggagatcagaaggcgctgatgtcctggaagatggatgggctgaccatcgttctgacttaccgggagggcagactttttaaagcggttacccggggaaatggagaggtaggcgaagtagtcaccaacaatgccagggtatttaagaatattcctctgcagattgcctaccagggccaattaatcttaagaggcgaggcagtcatcggatataaagactttgagaagatcaatgaggaaatcgaggatgtggatgccaggtacaagaacccaaggaatctttgcagcggttccgtccggcagctcaataacgagataacggcaaagcgtaatgtgaagttttacgctttttctcttgtggaagcagaaggggtggacttttacaattccagagccaggcagatgaactggctgatggagcagggatttgaggtggtagagtttcaggaagtaacccaggatacggtggaggctgaagttcttaaattttcagaaaaaatcgcccagaatgatttcccatccgatggacttgtgctagtatatgatgatatagcgtatgggcagtcactgggcaggacatccaagtttccaagggattcgttcgcttttaagtgggcggacgagttaagggtgacaaggcttttggagatcgaatggagtccgtcacggacagggcttattaatcccgtcgctatatttgagcctgttgaattagaaggaaccaccgtaagccgtgccagcgtccacaatatcagcattatggaagaactggaactaggcgtaggcgataccattgaagtatataaagcaaatatgatcattccccagattgccaggaacttaacgagaagcggagtcaaggatattccaaagaactgtccggtctgccaggggcagacggaagtccggcaggtcagcaacgccaaggcattatactgcatcaatccagactgccaggcaaagcatgtcaagtcctttgccctgttcgtcagccgggatgcgttaaatattgaaggattatctgaagcaacactggaaaaattcatttcaatggggtatattagagagtatgcggatattttccatctggaccgctatcaggaagagattcagaccatggaaggattcggcgaaaagtcataccagaatctgatagacagcattgagaaagccaggaccacaacccttccaagggtaatctacggcctgggaatcgcgaacatcgggcttgccaatgccaagatgatatgcaaagaattccagtatgatctggaggcaatgctcaaggctacggtagaagagttgaacgccatatccggcattggggaagtaatcgcgaccgcgttcgtggactatttttccaacaatgttcacagggaaagactgcgcaatcttcttgcggaactcataattccaaaggaggaagcagacagcgctgcccagatctttaatggggtcaactttgtaattacaggcagcgtggagcattttgcgaaccgcaatgaagtaaaggaattgatcgaaagcctgggaggcaaggtgacaggttcggttacttccaagaccaattatctgattaacaatgatgtgacaagcacatcgtccaagaataagaaagcaaacgaccttggcattccgatcatatcggaagagaccttccttaagatggtggaagaaggccgggacaagtagaaagaagggaagaagatgtctgatcaggacaataagaacgagaatgaagttgagaaagtagaagatacgcaggtagaagtagaagatacgaagaaggatgacgatgaatatgagaaggtatgcttcatatgcaggcgtccggagagcgttgcaggcaagatgatagagctgccaaataatatctgcgtgtgcagcgactgtatgcagaaaagtttcgacgccatgagcaatggacagatcgactacagccagctgatgaatatgccgggagtgcagatactgaatatggctgacatggagcagaatatccccaagcagcagaaagttaagaagaaaaaagaaggggaggagaaaaagcctttgattaatatcaaggacatccctgctcctcacaagatcaaggcaaagctggatgactatgtggtgggacaggaatatgccaagaaggctatgtccgtcgcggtctataatcattacaagcgggttgctacggatacgatggatgatatagagattgagaagtccaacatgctgatgatcgggcctaccggttccggcaagacctatctggtcaagacgctggcaaggcttctggatgtgcctcttgctattacggatgccacatctctaacggaggcgggctatataggagatgatatcgaaagcgtcgtatccaagctcttggcggcagctgaaaatgatgtagagaaagcagaacagggaatcatctttatcgatgagattgataagattgccaagaagaagaactccagccagcgggatgtaagcggcgagtccgtacagcagggaatgcttaaactgctggaaggaagcgacgtcgaagtgccggtaggcgccaacagcaagaacgctatggtgccgcttacgacggtgaatacgaagaatatcctgttcatctgcggaggagcgtttccggatctggaaggtattatcaaggaacgtctgaccaaacagtcctccattggattcggagcggatcttaaggataaatatgaccatgacaagacgatacttgagaaagtgacgacggaggaccttcgcaatttcggaatgattccggagtttttggggcgtctgccaatcgtatttacgcttcagggcatgaatgaggatatgctgatcaagatactcaaagagcctaagaacgcaattttgaagcagtatcagaaacttctggcgctggatgaagtgaatcttctttttgacgacggcgcgctggaggcgattgccaaaaaggcaatgaagaaagacaccggggcgagggcgcttcgggcaattatagaagagttcatgctggatattatgtatgagataccgaaagatgacagcattggccaggtgaccataacgagagaatacatagaagggacgggaggacctcttatcatgctgaggggccaggacgtggcaaggatacagtaatgagtgattatagttatctattggatttggcagttatattgctgtgtacaaaattattgggattggcaacaagaaaggtacagatgccgcaagtcgtgggggcgcttatggccggacttatcttaggcccggccatgtgcggcgtgttgacggagacaaactttatcaaggcagtggcggaattgggagtaatcgtcctgatgttttgtgccggcctggagacagatattaaggaattgaaggccagtggaaaggcatcctttatcattgcgctctgtggcgtgctggtgccgcttgccggcggatttgccctggcatatttcttcaacaagccgggcatgatcgcatcggatgcaggtggaagcatcttcctccagaatatctttattggtatcgtgctgacggctacttccgtaagtattacggttgagacgctgaaagaattaggaaagttaaagacgcgatctggaaatgcgatccttggagcggcgattattgatgatatccttggaatcatagcgctgacgatcgttacaagcctggcagattcctccgtgaaactttgggtcgtgctgctgaagatcgtgggcttctttgtcttttccgcagttgtcggctttatattctataaggtgtacaaggaatggacagagtccgcgcccaaaaatctgcacaggcatgttatcattgctttcgtattctgccttctgatggcatatacagcggaagaattctttggcgtagcggacattacaggcgcatttttggcaggccttattatatccaatacccagagatccgtattcgtggagacaaagtttgatacgctgtcctatatgctgctttctcccgtgttttttgccagcataggactgaaggtagtattgcccaagatgtcgcttaccatcgtcatattctccctgctgctgatcatcgtagcggtaattacgaagatcattggctgcgggctgggggctaaggcgtgcgggtacaagccttaccagtataagcggattggcgtgggaatggtctcccgtggagaggtggctctgattgtggcaagcaaaggagcctcactgggactgcttgggacggccttcttaggaccggtcattatcatggtggtagttacaacgattattacgcctatattgctgaagattgtattcaaaaaaggcccggatctgcctgtcccgaaggaacaggaggtatccagctactacgaagacgcggccatccttcgcggagaagccaaataatctgacatatggaatagaatgcctcatatacttattaaaaagtatatggggtatttttatggatggagaaacatgccgggataagattctgtcagaggattactgggattttctgatcccaaattttcggatggatgacttggaccaggtgccgccggaacggtcctgctaccaagagatggactttggctatcgcgcggtttatattgataacagcatactgcctccgcttacaatccgggaatactggtataattctatcccgaactgctatgcgcttctggatatggagactttgaacatagcaggaatcagtgcggttcagaactatccgacgcttcagctgatggggagcaacgtgatgattggttttctagatacaggtattgactataggaacccggtatttacaaatattgacggatcaacaaggatcgcagggatatgggatcagacgatccaggatggtacgcctccggaaggacttgattatgggagcgaatacacggaggataggatcaatgaggctctccgctccgagaatccgctggatattgtgcccagcatggatatgaatggacatgggacctttcttgcaagcgtggcagctggaagcgcggacgttccaaaccgctttcttggagctgcgcccgaatccacgattgccgttgtaaaattaaagcctgcaaagagttacttgaaggatttttatgccatacgcagcgatgcggtctgctttcaggagaacgatattatgctgggactgaagtacttgaacgatctggcgcgggaaaggaatctgcctcttgtcatgtgcattgcccttggaaccaacttcggagggcataatgggacgtctctgctgtctggcatgctggatgcctattcctatatattaaaccgcagcgtagtaattggcactggaaatgaggcggccaagcggcatcatttttaccatatgctggatggaattaacgaagagactagcgcggagattcgcgtaggagatggcgtggaaggctttgttaccgaattatggacgatgcttcccaatgtggtgacgatttccatcacttcgccctccggggaacggacaaggcagatatccataaggcagggagaccggtataatctgagatttgcctttgagaagacggaggtatcggtcgagtaccgtcttcttttggaaaataacgattcccagctgatatttctgcggtttcagaatcctgtgccaggcatctggcagatcaatgtggagcctgttcagattgcagagggagattttcatatctggcttccaattcaggagttcctgtccggcgaagtctattttctggaatccaatcccgacacgacgcttacggaaccaggaaccagcagatcagcaatgacggtggcctattataatgggcgggagaatggagttgatattaattcagggagaggttatactagagatggattagtcaaacctgatttcgcagcgcctggggtgatggttacaggtgcgggattaaacggacgattcgttaccaaaagcggttcaagcatatctgccgggatcacggcaggagcggtggcgcttctgatggaatggctgctgaatgagccgggagcgcgcggcgtgaactccagccagataagaagcatcattctgctgggcgtaaaccagaggccgtcaatggaatatccgaacaaggaatggggatatggaacactggatctgtatcgtgccctagatacgctgcggagaatataaatgataatatcaaaggataaaaggagaagaaaagatggcagatttttttgaagaattagggaaacgaatctcagatgtggcaagcgatctgggaaagaagacggaagataccattgagatccagaagatcaaaggagacatccgctctttgaagcgtgcgaatgacagggatctcatggatctgggacgcatggtatatgacaagttccaaaaaggagagattccggataccgattatatcgaactctgcggcaacattgagaagcgcgaggaagagattgagaaacaggaagaagagattgtaagaatcaaagaggatatatagatgctatcattaatagttgccggcacatttacaatactgctgggcctggatgtgctgcttaagcagcacgtagaagaaactatcaggcccggggaagaaaaagaactgccgggaggaaaagtggtcatacgcaaggtgtataacaagggattcctgctgaattccctggaaagccatcctgcgctgattaagacggtatccatcctggcgggggcaggcgtgcttgcatgcggcgtatggacatttgccagaaaaggacatttcactgagaaactgggcatggctattctgggggcaggcgcttccagtaatatatttgatcggctatcaagagggaaggtcattgattatatcggaatcaggagtaaaaatcagtttcttgcaaggctgacggccaatctgggggatttctatatccttctgggggcagtcttgctggcgctgaaaaatggaaggaaatagggcgtacgtacatatgagacagggaaagatattctggtcgatattaaaaagaacccatgctgataagatcgtaacgggatttggaatgtattttttgataagcgcgcttgtcattatgctggcggagccggggatccatcggtatggagagtctatctggtactgcttttccgtaattacgacgattggattcggggattttacggcagtgactgtcattggaaggactgcctcaatcatactgggcctgtatggggtcatcgtgcttgcgatcataccagggattgtcgccacttattacatggaagtggtgaatttcaaaaatggggacagcggggaagcttttatgtacaaattggaacatctggatgaattgtccaaggatgaattaaaagagatatccgagaaggtgaagagccgtaagtttaaattataagaggcaatggtggcattgcctcttttctttataatctgctataggcagaagaattcttttacctggcccagtataattcccataagtctggttctggactcgacgctggcccagcccacgtggggagtgatgaaaagttttctgctgtctgtaatgcgaagcagaggattgtccggactcattggctccgtacaaagcacatctaagcctgcggcggcaatctcgccttgctccagggcggcagcaagatcctgctcgacaacgatggggcctctgccaaggttcaggaagatgcaggttttcttcatcttttgaaatgcccgggcatcaatcagattttccgtatgcgcattgagcggcgcgtgtacggagataatatcggaagaggcaagcaaagtatcgaggtctacctgatggtagccatcctgaggggcgcttccggagggagaggcgtagatgacatttagcccaaaggcctccgcaatagaggctacccgcctgccgatattgccaagcccgatgatcccaaaggtcttgccatgcaactcataaaaccgttcttcaaagtgcgtaaagatcgtatcattggtatagcggccttcttttacataatcatcatagtaccgaagtttctcaagcaggaagagcagcattgcaaaggtgtgctgcgcgacggattccgttgaatatccggcaacattcctccatgcaatattgcggctttttaaatagtccttatccagattattggttcctgtggcagtcacgcagaccagcttcaggtttcgggccttcccaatagtagatttatttacctgtatcttatttacaattattacatcggcatcttcgacccgcccagggacttcctcggaagtagtgaaaggatacttcaccacctcgcctagctggtcgtagccggacaagtcgatatcttcgccgatggtctttacatccaggaacacgattttcataaaacaagcctcccttacatattcatttatcagtatattggaaaattatatcacaggaaactgattaggaaaatagaatacttagaatcgggtatgaaaaaagcgggtgatgggaatcgaacccacgtatccagcttggaaggctggtgttctaccattgaactacacccgcatatcggggtgacaggattcgaacctgcgacctcctggtcccaaaccaggcgctctagccaagctgagccacaccccgtagtaacttatctgattgtgaacgtttcacgctgtgaacgaaataaataataccatttttggaaacaaatatcaagagttaattgcaaagaatgttaaaaaaatgccagccatgaagtatcccatggctggcattccctcttattctcctcccgggccgtctttcctaggccgctcggattctggcagcggttccactgcctttgtaggattcagacgttcgtcattggattccttatccttctgcttgtctgaaatcgttggaataggtgcttcaactatctctatcatgcgtaatcctccttgcctattctgcctctccctctgccacgatatcttccagaacgtgaattaagtcgtggatggattccagccttacatcccgttccaggatacagtttttaagattaatagacagtgattcgaatttgtcccggattgccggggatacataggatgccatataatcacctcgctatagtatgtgcagaaagcggccggtttattaattttgaatttggcaggggccctaagttgaagtgaaggatacccgtgtgacgggttatccttcaggaaagaatttcagataattatacaagatgtccaggaattcgctgttagtaggtttatcgctgagcggatatccagtgatatctattaggaatctgcgattgccgtgataccagcaataggaaatgacagttcgcaggcaatgttcaacattatccacggtagtgctgaactttttggcaatatctggatacaagaacttgcagatcgatctaagatattcatcattttccaagcacagcagcaaggcgtactgcaagtaccggaaaccttgataggtcgagcggattcccagattcagcagaagttttcttatgtacttttccatactttttctcctttcctccaatagtcggcatatagattttatatggaaaagtccgggaattgggagaaatgacaaaagtatattgaactcgtcgagattcgaccggcttggaaataggaaataaaaaaatggagtatacgggacttgaacccgtgacctccacactgccagtgtggcgcgctcccaactgcgctaataccccataccgagattatagcatggaaactggcagatgaaaagcagtaattttactatttccgttctgaatcatcaatcatcttctgaagattgatacgcattgcgtctttatcctctgtggagaggcgaagagtgtcttcctctttcaactcttttaatgttctgtctgcctcctggacaaatgctgttttaataatttttttaatatcatccatagaatgcacctcctattactatcataaaccagatagagcactgttgggaaaggaaatatatggaatataagtatttttaatatgtgggcactacaatttaaggagttcttaaaaatgtaatagaaaatcaggagaacagtatggtttccatggcgaatatgcatcctaatctcattgcgcgttcttgaatttaagaattccttaagttgatactgccataccattattgtataataactactataccatgagatgaataattgtatatttatgatagataatctagtttgaacatgagaggatgagcacatagatggcacaaaggaagaggacaagacagtccagaaggaggcagcaggttcgccgccagctgctgatcgtgctggttttaattgtggcggtcgtctgcgcggcagtcagttgccatatacaggaggcaaggcacaaggcagaggcaaaagcagctgtcacgacaggtcagcagaaatctgcgaaggggaagaaggagaaagccaaggtaaaggtagagacgccaaagcagaaactcaagagggtggaacttacagcgaagcaaaaaggctatcccgacagcgtagtcggactgctgggaaaaaataaagagaccgtggatttcgtggaggactatgaggcgaagaaggatgttccggcggccgataatatcggggagagttacgtggagggacagatcccgcaattgctgcaatgggacgagcgctggggctatgcttcctacggcaccagtatcgtggcggtgagcggatgcgggccaacctgcatggctatggtagcggcagggcttaataaggatccgtccataaccccggcaaaagtagcggcatatggaacagagaatcattatgtagacgaggataataacacgtattgggcgtttatgcgagaggcagggagcaactggaacctatcctcctatgagggcgttcttacggaagaacaggtaggcgcagaactggcggcgggacatccgattatctgcagcgtaggacctggagattttacccagaatggacattttatcgtattgaccggatatgagaatggcgttgtcaaggtaaatgatcctttcagccagaaaaacagcgaggcaacctgggtgtttaaagacatcgcggaccagatcaaagcgatgtgggtatactctttgaagcaatagatggaaggcagatgctgccttccttttctttgcctgaaaatgattttgcctgtattgatctgtcggaatatatttccggtaaatatcacgacactgtgacaattgttgaattgaagtccagcgtcaatatggatataatagagtcaataataagcagcagaggtgtattatgcggaaaatactgatcgtcgaggatgacagggaacttaatcagggaatatcttatgccctcgggcagggcggctacctggcaattcctgcctattctatccaagaagcacaagagctctatacaaaggaaggggcggatcttgtgctccttgatgtgaatctgccggatggggaaggatttgaattctgccgttttctgagagggaaatttgagactcctgtaatgtttcttacggcaagagacttggaggaggatgttctgaaagggtacgagctgggagcggatgattatattacaaagcctttttccatacatgtcctgcgaaagaagatcgatgtgatcctgagaaggctggaaaatcatccaaggaatgcatatgatgatggattcctgcggattgactttgacaaggcgcaggtgagcgcgggcgataggatatgcagcattactcctacggaattcaggatgctgcggctgttcatcgaccattcaggccagctgatgacctattcggtactgctggaagcattgtgggatatgggcgcccagtttgtggataagcatgccctggccgtgaacgtcaatcggctcaggggcaagattgaagacgaagaacacagatatatatcaaatatttatgggatgggttatcaatggctggattagcggtgattatcatatgcctgacgctggcgctcatatggatgtggaagcggatggagaagatgaagcaagagatctatacatttacggacaggctggaagaatgtctggacgcaatggcttccggcgaggagattaagaatccggagaattgcgaggactccctgtgggataaggtctatgagaggctgcggaggattgagaatatctggagcaggcgggaggaagaaagcgtggcagagaaaaagcagatcaaggagctgatctccgatatctcccaccagaccaagacgccgatagccaatataaagatctatctggaactattggataacgaggaagaaaatactgagaaacaaagggaatatctgggaaaaatagaagggcagacggaaaaactggatttcctgctaaaaagcatggtgaagatgtcccggctggagacgggaatcatcgagatccataagaagccctgcagcatctatgaaactttgggacgcgctgtggcagccattgtcccgaaggccgagaaaaagaagattggcatctatgtggaatgcccggagaatctgatgctatgccatgacagcaaatggacggaagaggcgatcttcaatattctggataatgcggtgaagtatacgaaggaagactgcccgcctaagagtagaaatattcagatcggcgtagctgtccaagagttttttacgaagatctctttcaaggattctggcaaagggattgccatggaccggcaggcggagatattcaggcgattctacagagagccggaaatacatgaccaggagggaatcggggtaggtctgtatctggccaggaagatcattaccatgcaggatggatatattgatgtgcagtcagagccggggaaggggtcctgctttcgcattttcctccccaataacagcaaggagtcatacgaatagaatcacagtattgtgaaaatcctggattgtgagcagtttgtgatatttaccagatatgcttgaagtatcaaagaaaggagaatcagcagatggaatcatggattgtacagacacaggcattgagaaaatattacaagttggggaacaatacggtgaaggcgctggacggcgtggactttaaggtaagagaaggagagtttgtagccatagtaggaaagtccggcagcggaaaaagcacgcttcttcatatggtcggcgggctggataaccctacggacggcgaagtatacgtagatggaaggaagctgtccaagatgaataaggagcagctggcggtattccgaagaagaaaggtgggattcgtgttccagagttataatctggtgcaggatttgaacgtatatgagaatatcgtactgcccatagagttggatggagggcatattaatgaagagtttatcaataacattctgagtctgctgaagcttacggagaaaagagaggcgcttccttgcaccctctctggagggcagcagcagagagttgccatagcaagggcgttggccagcaagccagcgatcgttctggcagatgagcctaccgggaatctggatacggccaccagccatgacgttcttggccttctccgggtggtggcaaagcagtaccggcagactatcatactgattacccacgatcaggatatcgcccagctggcagaccggattgtccgcattgaggacgggcggatcgtgaagggaagtggcgcggatgattaagaataataatacacggatcatcagccggatggcgaagcgcaatcttgtaagcggcaggcggaagaatctgattatgatattcgcgatcctgctgtccaccttcctgctgttcaccattctaacggtagggagcacatactttaagatgcagcgtatccaggatgtccgtatgaatggcggagatatggatgcctatatttatgggggatttaccgagaagcaaaagagcgtatgcgaggagaatgcggatatagccctggtaggacaagaagcgattgccggatggggagtaaagactgatcaggatgatacgctgcatacggtattcgtatgggcggatgaagtgatgtgggataagttacaggaaccggcgcgtgaatgggttaaaggcacgtatcccaagaaagacaatgaagtcatggcgacgaaggaggcattggaagattgcgggctggagggcctggatgtaggagactcctttaccataacctatggagacgggacgggggagcatacgaaagaatttaccataaccggcatgtggggcggattcggcactaaaaaggtattcaatgtgtcacgatccttttttgaccagtctggctttcaactcacagactatggaaggggcttcctttacctgaagtatgcatcttccatcattccgcaaaagacgcaggatgtgctggagaaaagcctggaactgggtgagaagcagcgcctgatctatatgtcagattcggcaagttccgtgaagattatggcaggcatggcaggcctgatcctgataacgtgcatcagcgcctaccttctgatttataatattctttacctgtctgtttccggaaataccagatactatggcctgcttcagacggtagggatgacaggacgccaggtatacgcgctgatgaaaaagcggatgctgtatataggggcagtgggaatgaccctgggtatcctgctgggaagcgccgcgtcattcctggtgataccttgggtggtaaagacccttggcatccatgaggaagatattgccgtggcattccaccctgccatattccttctatgcctaatcctcatcagcctgaccatatggctggggggcaggaagccagcgaagatagccacgtcagtctctcctgtggaagcgctgaactaccgcccaaataagacaagcaaggaatcgcataagactgggaaaggcaatctaatatggcgtatggcaagagagcagtttcagaaagacaagaaaaagtcgaccatcgtcatactgtcccttgcagccagcctgtccgtgttcctgtgcctgattactttgattgcgagtcaggggccgcgtactatggtgtccagctttatggataatgatctgaccatattggacgatacggtgagaaaagaagaccagggggaatggaagggtcttttggacaatgaattcctatccgaaatccagagcaacccatccgttaaggacgtccatccgcagatgacggaaaggatcgtggttccctgggaaccggaattctcagaagtatatatggagaaaatgtatgaatactggatggagcaggattacgaggagattaaggaagagtatcagcagcatccggagaagttttactcttatatgacggcgatcgatgagacagagttcgactatttgaatggcatgctggatgacccggtagataaggaagaatttatggcagggaaatcttgtatcctgtatcaggatgatctggatattgacaaggagatgctgaaaggaaagagtattgttttttccaggtatagccaaagggatacgccccaggaactgaagatcgcaggcatgactcaggagcgttactacgctggaatgatcggcataacgccgaatattatcgtgagcgacgcttatatgaaggagacggtggaacatccctatgtgttcagggtggggattgactatcaggaagaatacgatgagacggtagagaatgagatgaaagatatgatgaagtccagcccttactccaaagatttttcctatgattccaaactggaggctatgaaagaagtaaaagaggctcaggggaatatgctgggcgtaggcattggcatcatagtggttcttgcgctgatcggcattatgaattatattaacaccgtatcagggaatatacagagccgccagatagaatttgcgattatggagagtgtaggaatgacggaccggcaggttaagaggatgctggttagagaaggcatcctctttgcggcagcgtcgctgcttctgacggcgacggcgggcatggcagtcacttatatggtctaccagtccatgaattatatcggcgttccattcgcagtgccagtccttccggtaatggctatgattctgttcatatttgccgtatgcgtaacagtgcctttggcttcctaccatatgctggctggaagaagaaccattgtcgaaagagtaagagacatataaaatggctgcctgtattatatggaatgtctctgaaaaatgggaaaactacagcccatagggggcttagggcgtcgtaagaggattcgttcggccatttgtatgctcctgtaaactgtagcccatttttaacaggctttcatcttcgccagcaggaagggttaaggtagctccctgtggtaccccgctcttatccttcccaaaaggaatcgtaagttccgggaagcctgctgctgcaggcaaggtggaggcggtgctgttcaaaaaggcaatgccgtccagattatgcttagtaaaggctgtatctagaacagatgcggccttttctatacttttgctgatttcatcataatctgcggtttcagtctccgcggctttttcgagatagtcctgaccgtatttagcatttgtgtctttttctttattgttaaaggctattaagtcatccagggtcttgacgggcaagccataggcgctggcaaaatctttataatcatttttgaaggtcaagtggatattgccgaagatgatgacctcttcctggctgagtgttatatcaatgacttttgcccctgcattctggagcatctctttcaggatgcttacctgcgttttgtcattatattcataactggctaatccaatcattttaccctgcagataatctttatcccattccggattgagagactggccagacatggcattgtatacaacggctgcatcctggacactctttgcgatcgggccaggggtatcaatctgccgtatgaggggtaggatgcctgtagcggagacggtggaacgggttggcttaaagcccactacagaacccgcggatgcgggggcagtgatagaaccgtctgtctctgtgcctatggaggccggggtcagattggcagttacggaaacagcgcttccgctgctggagccagatgctgagatttttaaaggcccgaacgggctgatggtttgccctttcacgttactgtatccggcgggagctatactggacatgtatccggcaagttcagagagattattctttcctaaaataatcgcgccgcggttttttaaattggccgcaagatcagcatccttggcagggataaaatctgccagcgcagcagcgccggcgctggtagggataccggcagtattgatgttatcttttaacagaacgggaattccgaatatatcagaagggttttctgtccggcttttgcgctcagcgtccttttggcgggcttcttccatcgcgttgggattgatcgtcaggacggaattaagaccatgttcattttgatccagagtcttgattctgtagagacagattgccgtcagttcctcataggtgaggctgccattttttattgcattctggatatccgcaatctctttttcaattacaagtttttcctttttctggacaatactctcaatatccagaccggaaagctggctgtcaatattcgatatcagttcttcattatgataagccagccattcttcccccggcggggcagccattttataatagaggaagccaccggctgctatacacaacaagaggataagggctccaataataatcttcttttttttggtcatttcgttttcctccaattgattgtaataattttgtatatctgaaatgcaatcttaataaaaaagaaaaatccgctgtatcgtagagtttgcgcttttgtatggaattatacgacaggctctgtatatttgattttaacagaattgtttcatggcaagagtagtcccaacacctgctttgcctttttataagataaacagattatagtatagtttatgccagattaagcctggattttgaaaaaggctttcagtttttaacagcctattaggcgtgcgcttcatatggaatacacgccatattattcgaaagaggggcttctgctttttagaatgcttttgatttctaatacaaaacgttctacatcatccggcggcgtaagggaatacagcagcccataagggacgctgtattcccaatttaccgggatggtaaccagccccggatggatatccgtccagcattccagggtaagcagcacatttcctgtttccgcacagcggttaaagacggagatatcatagaaatgcggcgtgtcttcaatctggattgcgggatggtcccgcttcaaatccgctcggatgcgatcgtttgcggaagaatctccttctgccaccatcattagtatctccccatacaaatcagatatttccaggcgcccttttttagccagagggtgctctcttgatacggcgcacatttttttatagtgccccaaaggaagcatattgcatttgtccagccacattttggagtcgcatacgcctaccagaaagtcaaacttttccccaagccgcgagatttcagagagaatgtcttcatgattatcttcaaagggaacaagatgcagcttatagttggaaaaactccggctggccagataccatagatccatgaacggcttggcaggattgagcatggaagtcccgacacaaaacgtattgtcgtcaacagccattgcctgcctggcattttcaatagaacgcctggaatagtcaaatagaaaacgcgcatccttataaattacttcgcctgccggtgtcaggcggattccatgggaagtcctcaccagaagttttaaattcaggtgcttttctagtgtgttgatctgcttcatcacagcggtgggtgatagaaacagagcctcagccgcttttgtaaaacttccgcagtcagcggcgcagacaaaggcgcttagcaaaggattaaacattgtcaggcctccttgtatgaactatatgttaatactaatataacgaaccggagattccgtgtcaagagaaatggttttataatgaagatagataacggagaggaggaatgaaaatggcggatttaatcgtttatttttcaagaaattatgaaaattatgtcagcggagcgattcgaaacctggatgtaggcaatacagaggtagcggcatgcattatccaacagttgacgggggcagacctgtttaaactggagccgattcaggaatattccaggaattataatgaatgtatcgccgaggcgcaggcagatcagagacggaatgccaggccggaactgagatcttatccggagaatctggatggctatgacactgtttacttgggatttccaaattattgggggacaatgcctatggcggtatttacctttttggaacattttgactggagtgggaagacgatccgtcctttctgcacccatgagggcagcggcatgggacgaagcgaagtggatatccggcgactttgcaggggagcggatataaagcctggcctggctatccagggtgcaaaggcgagtctcgcgcgtaaagagattgaaggatggatttgatgcaggcaatagcggagagcaaggagggtgtaagaaaatggcagtaaaacagacggcagggagaaatgcgcttggggaattcgccccaaaattcgcgcaattaaatgatgatgtgctatttggagaagtatggagcagggaggataaattatcccttcgcgaccgttctttggtgacggttgtggcattgatggcacaaggattagtggattcctcattcaagtatcatttgactacagcgaaaaagaatggaatcacaaaagcagaaattgcagagattctgacacatgcggcattctatgcaggatggccgaaagcatgggcagcattttatatggcaaaagaggtgtggacggaagaacgtgacggcgatgaggctgatcatgcaagaaaggcccatgaagattccatggttttcccgatcggtcagcccaatgatggttttgcacagtattttgttggacagagttatctggcgccagtctcgacagatcaggcggggatctttaacgtcacctttgagccgggctgtcggaataactggcatatccaccatggggacaaaggcggcggacagatcttggtctgcgtggcaggacgaggatattaccaggaagaaggaaaagaggcacgggaacttcatccaggagatgtagtcaatattccggtgggcgtaaagcactggcatggcgcagcgccagacagctggttttcacatctggcggtggaagtgccgggagataatacaagtaatgaatggtgtgaagcggtatcggatgaggaatatggaaaactgcggtaatctgttataatgaatacagattaaaagaggaggaggaaatccaatgatttatagagagtttagagagaaaaaactatcagggcttggtcttggcatgatgcgcctgccggtcattgaaggagatgatgccagcatcgatatggcccgtactgctgaaatcatcgattatgcctaccagaatggaattaattactttgatactgcatggggctatcataacggcaattctgaacttgcagcagggcagtgtcttagcgcttatccaagggaaagctactatctggccagcaaatttcccggctatgataattccaatatgccaaaagtaaaggaaatcttcgaagaacagttaaaaaagtgcatgactccatactttgatttctacctgtttcacaatgtatatgaagggaatatcgacgattatctgaaccccaagttcggtattttcgaatacttgatggaacagaagaagaatggcagaatcaggcaccttggcttctctgcccatggcagtatagaagtcatcaggcgattcctggatgcttatggggagcagatggaatttgggcagcttcagcttaactatatggactggcattttcagaaggcaaaggagaaggcggaacttcttcaaaaatccggcgtgccaatatgggtgatggagcctctgcgaggcggaaaactggcaaaggcagatgagcatatgacgaaggaactaagcgcaatgcgcccggaagaaacggttcccgcatgggcgtttcgattcctgcagacaatccccggcgttaccatggtattgtccggaatgtctgatatggaacagctgaaagagaatattgccatctggcaggaggataagccgctttccaaggaagaatttgaccgtctgacggaactggcggatgaagagacaagaaaaggcgggctgccctgtacatcctgccattactgtaccagccattgtccgcaaaaactgccgattcctgaattgattgctctttataacgagcataagattacaggcggcggatttctggcgccgatggcagtgggcagcatgccggagaaagaacgcccggcaaactgtgtgggctgccacagctgcgagcaggtatgtccacagcagatcaaaatctctgatatgatgagagatttctcttccatgataggcatgtgattgaaggtcagcaattcttcctgatcagatctagaaaggcttttaccgcaggcgaaaaagtctggtattttttcgttacaatgtataaatctacagatagttcaggggttatagggcggaaggccaggttccgcccttccgtattgactagtcggtcaaggcagagtgcatagccgatgccatgctccaccatgaatgtagcattgtaaatcagattataggttgcgataacattcagggaagagtaatctaatccgaaccattctaattcctgatgaccggaaaatgtctgctctgacagaatcaggggcaaggatttcaactggccgatatttacggaattctgtttggccagttcgcaatctttcggaatcaatagaccaaacgtatcctgctgatgaatatttaggtaatcatatttttcctgccgtaacggccccagcaggagtcccatatctacaagccccttatccagccgttctaataccgtatcagcatcaccgctgtgcgtgtgaaaccggacatcggggtatcgttcatgaaattctgtaaggaatccggtaatccaatccataacgatcgtttccccgcagccgatggaaatgtctccgctcaagacttccgcatctgtatgaagggcagactcggtattgtcgagcagttccagaatctcctgcgcgcggttgcgcaggaaggtcccctcctcggttagagtgatttttcgttttcctctgataaagagctgcttgccaagctgcttttctaagtccatcatctgctttgacaaagtggattgcgttacaaatagtgtttctgccgctttggttatattctgttctcttgctatggcaagaaaatatcgtaaaagtctcgtctcaatcatcgcattgtatccttccgttttcaaatttcttcctgtagattcccttgttaccattatatactttttatcattcctgtaaacgatgataaattattattaataactgtttgtaattatctgttgccaaatatacaattaggttgaacttgaaaggagggttccggtttgaaatccgaaaatgaatatttgaaaagcagtctcaaggactgtggatttcaggaaaaagcagcggcaaggtatatgtattatgaagaggcaagccagatatccgatatgctgggtcttttgaagcagcagcgcagaaaattgatggatgatcttcatgccgcacagaaaaaagttgacacgatagattttatgattcgttctgtggaacaaaagaaggaggagaaccatgagcaactatatctgtagattgaatgaaaatgtaaaaagagagcatgtccgttactacaaccgatacggtatagccttggcgggcgatctatatacggcaaaggctatggatcagaaacagaaacatatggcagtcatagtaggggcgccatatggcggcgtcaaggaacaggggccttgcgtctatgcaaacgaactggcacaaagaggatttattgtgctgacttttgatccctgctatatgggagaatctgcgggggaaccccgccatgtttcctctccagacttgttcagtgagaatgtcagtgcaggtgtggactatttagggcttctgccctatgttgacagggaaaaaattgcagccattggaatctgcggcagcggtggcttttccttgtcagcagcccaggtcgatacaagaattaaagcggtggttacggcaagcatgtatgacataagtgcagcctcccgtctgggagccgataaggaaagtctgcaaaaaaccaaggagaggctcagtgaacagcgctgggtggatgctgaaaatggctatcctgaatggattccatcttatccggaggagcctgtggaaaaggtgccggaaggacttgatcttgtttcagatgagttttatcgtttctatggcgttaaaagaggacaccatccaaatgcaagagccggttttaccacaacaagcgatctgtcatttatcaattacccactccttgaccatatagatgaaatctccccacgcccgattcttctgattatcggcgacagggctgcttcccgtttctttagcgagcaggtctatgaaagagccgcagagcccaaagaactttatgtcgtggaggatgcagaacatattgacctgtatgacagaacagataggataccctttgataagattgaaggatttttaaaggaaaacctgaaataaacaagaggatggaatatgagaagaatcgtaattttcatctctgctatattcctcctgctgggcatgaccggatgcggaaattcaagcagcgtccaaaccccttctgatgcttccgaggaaagcagtacggcacagccggaacagaatgagagcggaccagtagacagagaggagaacgaaactatgaatatatctgtaaaatcagcggatcatgaactgatttatgaactgaataacagccaggcagccaaagagttgtatgctcaactgccgctgaccatggaggtggagcctttcagtaataatgagatgactttctatcctccgcaaaagctagatacatcaggtgccccattaagcggcggcgaggccggttccctgtcctactatgaaccgtggggagacgtagtgatgttctatgctccctgtgaccccaatggcagcctgtatgaacttggaacgattctttccggtaaagaggatattgataaactgaatggttccattacgatttcaatttatgaggaataggaggattaatgggaaatgaacaagtacagcagcaggatgatcctgatcttaacgcttggggttttcgggattctgaatacggaaatgggaattgtaggaattcttcccatgatcgcagaacaatataacgtaagcattgccaccgcggggtggctggtcagtggttttgcgctggtggtggcagctgccggaccgacgatgccgctgctttgttccaagatgaatcgaaaggcattaatgctggtagcgggcggcatttttatgatcagcaatatcatatcggcatttgctccgaattttttcatactgcttatcgccagggtgatcccggcggctttccatcctgcctatgtatcgatggccctgaccgaggctggaaaagcggtaaagccggaggaatcggccagggctgtagcgaaagtatttattggagtttccgcgggaatggtactgggggttccggttaccagcctgatcgccgtccggacttcttttacggttgcaatgctgttttttgcagcgattaacattgtggtatttgccttgacggtcttctttattccgtccatgccggccacagaaaccatctcctatggaaagcagattggcgtattaaaaaatccatctatggttttgtccatcatcattgtcattttcctgaatggcgccatctttggcttttacagctatatatccgattttatgggaactattaccgacatcaatgcggaatccatcagcctgtttttgttgttctatggtttggcaaatattgtggggaatatgatcgcaggcaaggttctgacggttgatgcgaaaaagtctacatttgttctgccgtttgcattgtttgcggcatatgcagggctgttcctgacaggcaggcaggccataggtacggcagtcttttgtattgtgattggggcattggcaggaatcaactccaatgtaaatcagtatctgatcacagaggccgggccccaggcgcctgagttttccaatggcttataccttacctcggcaaatctgggaaccacctttggaacatttatctgtggattgttcataacggcaatgggtacaagatattccctgtatggaacatttacttttattgtaatagggctcgcggcgattgcattaaagatgaagatggaaagacaggcaatagatcaaggaagaagcaaaacgaaaggagaaatgatttttggcaagtaatgtgaaattgagcaatggaatcgaaatgcctatggagggctttggcgtatttcaggtgacagatcctgatgtctgtgagcagacggtattagatgccattgaaacgggatatcgcctgattgatacggcgagttcctaccagaacgaggaagcggtaggaagggcaatccagaaatctgaggttccacggggggaactttttatcacaacaaaggcttatatccagcagatgggatatgacaagaccatgcaggcttttgaggagtcccttcagaagctgggactggattatctggatttatatctgatccatatgccctttggcgattactacggttcctggagagccatggaagaattatataaggcaggaagaatcagagccatcggtgtctgtaattttatgccggaccgtttgctggacctatgctataatgcgcaagttattccccaggtgaatcagatcgagcgccatccccattaccagcgcccggaagatctgcagatcatgaaagaacttggagtgcagccccaggcatgggcgccttttgcggaaggattaaaagggatgtttacggagccggttttgatggagattgcagccaggcacagtaagacgccggcacaggtgattctgcgctggaatgtgcagcaaggcgtgatcgtcattccgaaatctgttcataagaagcgtatggcagagaacctggatatctgggattttgaattggacgcggaggatctggataaaatcagcgaacttgacaaagattgcccgtctatgctggataccagaaagatcagcgaggtaaaaagggtatatgactacctaataaatccagttttaaccagtttataaattgagtcgtacggaggaagagccatgagtaaaaacattttgattatttctacaagtttaagaaaagggagcaattctgaaatgctggcagatgaattcatgcgtggtgcgaaggaagcaggacatcaggcagaaaaaatcagcctgagagataaaagagttggattctgcaaagggtgtctgacgtgccagaaaacagggtgctgtgtcatccaggatgatgcgattgctatcgcggagaaaatgcgtactgcagacgtgattgcatttgccacgccgatttattactacgaaatgagtgggcagatgaaaacattgcttgacagagccaattccctgttttcatccaagtacgcattccaggatatttatctgctgacagcagccgcagagaaggaagaaacggccgcagacggcgcaataaatggtctgcaggggtggattgactgctttgagaaagcccacctttctggaactgtatttgcaggaggagttgatgcggcgggagaagcaaaaggtcatgtatcgctggtaaaagcgtttgaattaggaagaaatatatagaagatgtgtatcaggaaaaggagaattaaatatgttaggaaattttgtgttttcaaatccaacgaaactctattttggggaggattctttgaattatctcaatgaggaattgcccagatacggaaaaactgtgcagcttgtatacggaggcggctctatcaagaaaaatggaatctatgataaggttgtggatatcttaaaggcgaatggcaaggtgattgtagaggatggcggcgtcatgccgaaccctacggtggagaaactatacgaaggagcaaaacttgcaaaagaggcgaatgtggatctgattctggcagtaggaggcggctcctgctgcgattacgccaaggcagtgtctatttcagcccattgcaaggaagatccgtgggaaaaatattatttgaaatttgaagatgtagatgcagatacgaagatcattcccgtaggatgcgtgctgacaatggtgggaaccgggtcggagatgaatggcggcgcggttatcaccaaccctaaaagcaagttgaagatcggtcatgtttttggggacagagtattccccaaatttgcaatattaaatccgacctttacctattccttgccaaagtatcagatggcagcaggcttctatgacattctgaaccatattacagaacagtatttttccggagaggatgacaatacatccgactatattatggagggattaatgagatccctgattcatagttcaaaaatcgcggtttgcgatcctgaaaactatgaggcaagaagcaacattatgtggactgcgacttgggcgttgaatacgctggtggcaatgggaaaagagacggactggatggtgcatatgcttggccaggcagtgggagcccatacggatgccacccacggcatgacgctttcagcggtatcgcttccctattaccggcatatcatgccttacggactggcgaaattcaaacggtttgcggaaaatgtgtggaatgtggatcccaaaggcaagagtgaggaagagatagcagaagagggactggcggctatggaggcctggatgaaggaaatcggcgtggcaatgaatatccgggaactgggcgtgacggaagagatgctggacggccttgtatcatcaaccttgataatggaaggcggctataaagtactgaagaaggatgagatactggaaatctttcaagagagtatgtaaatgtacaaaggaataaaaatgccggggtatgaatgtatcttcatatccccggcatttttcacgcggaccattagaatggaaactgcgctggcgtatactggaccgtgatccattttaattcggtaaattcatcaatagaataagagccgccttcccgtcccacgccgctgttcttgacgcctccaaaagccacggtagagttatccgatacggtcgcgttattaatatggaccatgccagcctccatatcaagcgacaaggccatggctttagacaaatcgttggtcagcagggaggaagaaagcccatactcattgtcattgcaaagccgtacagcatctctttcatccttagccttaatgatagaagtcaccggaccaaaactttcctcataaaaaattctcatatccggtgttacatttgatagtacggtaggctgaaaatagttcccttcatgggttccgcccgtcagcagcaccgcccctttagagacagcgtcctttatctggctgtcaattatctggcattgctcctgcttgataagaggcccgatgatcgtatcctgctggtgcgggtctccaaccttcatagtctttgcataggcggtgaatttttcacagaactgatcatatactggttcttctacaatcatcctggaagtacacatacatatttgtccctgatggaaaaatgctccaaagcctgcaatcttaactgcctgctccacatcaaaatctttaagaaggatcagtggatttttgccgcccatctccagagtgtatttcttaagacgctgtgacgcctttgccgcaattcctttgccaacagcagtagagccggtaaaggcaaccatgcgtattctttcatcctcaaccagcatttttccaaccgcctcgccagaaccaggaaccagattaaacacgccttttggaaggcctgccgcgtccagcgccttggcgatcatgacgccggagatcggcgtagcgcttgcgggcttaagtacaaaagtgttgccagccgccaaggcaaaggcaacctttttaagggccagaagcaatgggaaattaaatggcgcgatgcccgcgacgacccccagagggagtctgcggatcatggagatctctcctggcgcctgctgctgtacttcgccgaatacccgccggcattcgcccgctgctgcccgaagtatatccactgcaaatcctgcttcaaaatacgctttgccaaaagcggagccgctttctcccatcagcacgtctgccacttcatctatgtgctcctgcatccagtctgccgctttaaggagaatccgttccttttcatcagccgccgtatcagcccacggcttccatgccttttgagcagaggcaatagcctcgtcgacctcttccctgcctgcaaaatggacctgggcgaatatggaatcatccgccggattcttatcctgagaaatatatccggttacggtattcttccattctccattgatgtatagttgatactccatccctggcacctcctttatctcatctttaacaaggctttgattgcgttcccgctgtgggatgcctcaaaagcctcattgatttcgtcaaattcaaatacgcggatcaatcggtcaaaaggaaattttccctctttatagtatgaaattaattgtggaataaataatttcgggttagagtctccctctacgatgcctataagagactttccttctcccataagttcttcctggacttgtatggtcagttctccagtaactcccagtactacggctgttcccaggaatttcacgcaggctaatgctttttttacaaaatcaggcacgccgcttgtgtcgattgcatagtctgcaccgcctcccgttatcttcttgatttcacctacgatacagtcgcactttttccggttgatggtgtgggtggctcccagttctttcgccagggcaaggctcttctcgttcccccctactgcaataatatttttgcaggggcatagatgggctgccataatggcactcatgcccacggtaccacagccgaatacgaccaggcttgagcctgctgttggtttcagccggtttaagacagcgcctgcgcctgtctggattccgcaccccagaggccccagtatatccagatccagatctttatctactttaataatgctgtttttgtgaacaacggaataggtcgcgaaggaagactgcccgaagaaggaagagatctcctgcccatctttcgaaagccgcttcgtaccgtcactcataacgcctccgaaattaatggcattaaaattctcacatgcatacggcctgcctgccaggcagctattacagtgaccacagtatccgaaagaaaataacacatgatcccccttctggaattccgtcactccttcgccgaccttctcaacaattccgcatccttcatgacctaatacggccggaagaggtacggggatcatctgctgctgtgcaacttcgtccgtatggcaaacgccgctggccgctatctttaccatcacctcccctgcacgtggatcctgcaggtctaactcttcaaattggaaaggcttccccttctcccgcacaactgctgcttttatcttcatatgctatgtctcctttctataatataattttatcatagcaccaaatataataagtttaaataatagtttgaatattaacgatattattaatattttaactatttttactgggaaacgatatattttgtcagacattaatatgcgagtacataaaaagagatgaagaaatgttttttggtattagcgtaatagaaggatagaaaaaaggagagtccttatagttcaggactccccgctaagtctatgtgctggattcattctttgtcacctcgggttctttggcggcaagaataaacgcatcccagtcatctgcgaaggtttcaatattgctgctgctgttttttaaatgtgcttccattagcgcctggcagtcgttggcaaatgcttcaatatcatggctgcttagatgaatctccatttgctgtatgcctttatcgtgcatagtagtaaatcgttctgatttcagcagcggcaataccataatgcatccccagacaataaagtcttctaattttgaatagcattcccgtaccattgcagatgggcactcttcgcagataaagtccaagattatgccaaagcaaagaaagccttgctttttttcacgaacttcggacagatcctgcgctaatttctgatattgttcaattggcgttgcttccagcgtaaagagcagaacacctcgaatagtcagagccaagaattgcagactttcccgatggagtcttaaatcttcatgaatgtcagatgtagataagtcaattggtttggattccatgcagacttttgtcccgctcccccgataagaagtagtcacgcctaaagagttaagcactgacagcgtacgtcttacggttatcagcgacacgccatattgttccgccatatctgtaagtggtggcagaaatgagccaatgggatatctgccccagaagatttcaccgataatttttgccgccagagaatatcggacttgggggcgctgccggtaaatattccatttaaaaggaatgggcttgatagactccaaatgatacttctcgcgggtcacattaataaattccattagttcctgtcttttgatggaatagtagttctcctctaattgaagaatctggcttaacgtcaaactgctaggcataggggttcctaacgcttgagcaagatcctcggccttccaatcagagtgtaaaaaatttacgtatctcaggcactcccagtaaaggtttgatagcaggccattattcattgggaaaatgttttcaacacagaatttgaccatagagggtgcctcatccataaatttttcgtatttctttcgatagggaattatctgattcaatttggatgaattttttagttctttctcccaaacaggcaaaaacaatagtttagcggcaagagaaaagtctcggattccatcctcccgcggcacaaaataacttgcctggtttttctcaaaatcttctggagttccctgatatacaacgatggatgcttttcgttcttctgataggatatatcctttttcatttaaacggctaaacgcagcacgaaccgtattacgtccaacttggaagatatcgcaaatctgcgaaattgatggaaggggatctccgtatttataatgtccgaataatatacgcgactcataataatcgtaaattaattcattaagcccgatattcttttccaatacatcagcctcccataacttttatgtgatggttttaatcatcattgcgccggaacagtctgagcgatctgttttctaacacttgccattagtttatcataaatagtccttggaaaatagaagaagatttcataattgggagattgggatctttttgttgattttatagatgggtgtgctataatatataaataaaattgtgactaacatgagcataattttggttctaatatgcacatacatacgttctaatggcaggcttggcatgcatgtcctgcagacagaagcggataaaaatttaaaaatgaaagaaggtacagaggcaacgcgatgaacgaagaaagaaaatctaaacataagatatcgaaaatagcagccattatatgtatcgtagcttttttgctttccgccgtcagtatttttattacttatgtaatgaatagaaatgcccagagcatgtatgagcatccatatacagtgtccaatagcgcgcgtggtatgcgatcgcgtctatgggatatgaaaagtttttccagtatacttataacgcatgcttttgattctaaggaggataaagactccttttttcaggaacgttatgatatgcaaaatgcagatatagagattattgacgaacggtatctgggcccagttgaagatgtggatgacctgcgcgctgctatggatggcttgatcgaagcccagacaaaagcctgcaattatgcagataaccactcagcgtatgagatacaggaatatatggataacaaggtttatccctggtatgaccgggtaagcgattccctgacgacgatcattgattttgcggatggcaagatatgcagcctgaatgaacaggttcagaaatcagggattacgtcaatggtcttttctttgattcttgctttttcagtaattggcttaacgattctgtcaaataaacaagaacggaaaagtattgaggagttatcccgcagggaacatgatctacaggatgctctttatcttgcgcaacaggccggcaatgctaagaaggattttctttcgcgcatgtcgcatgaaattcggacgcctatgaatgttatagtgggcatgactacgatagcgggggcaaatctggatgataaaatccgaataaaggactgcctgtcaaaaatagaattttcctccaaacatttactttcattgataaatgatgtactcgatatgtcaaaaattgaggaaggaaaaatatctgttaattacgaaccgtttcgacttccacagatgtttgaggcaatcatccctgctatatattcgcagacgtctgccaaaggtaccgtgtttgaatgtaaaatgacggatgttgtatcggagaccgtgattggagattctcttcgcatcaatcagattctgctcaatctactatcaaatgcgattaagtttacgcatgccggcggaaccatatgcctgactgctaggcagactcctgtgaaaaacagacgcacgaaactaattttgatcgtggaagacacgggtattggcatgagcgaagaatttttacatcgtcttttcacgccgtttgaacaagaggacggcacgttatcaagaaagtatagcggaactggcctggggatggctatcacgaagaatttaaccgacttgctgggaggatcgatccatgtaaaaagcaaacttggcgaaggaagcacatttacagtggaattgccattagaagttccggaagatgctatggaggcaaaagaatataaattagaaaatctcaaaatactggtagtggacgatgatgtaaatacatgcacgcacgccagtctgctgctaaaaaagatggggattgacgcggactgggttcagcatggcagcgaggccgtacagatggtacgaaaggctcatgaagcttactgcgattatgatgtatgcctgatcgattggaaaatgccggatatggacggtattgaagtgacaaggcgtattcgggaagaactggggacggatacattgataatcattatctctgcatatgattggagcgacattaagggagaggcaagaaaagcaggagtcaatgcatttgttgcgaagccattgtttgaatcatctttgtatcaaactttatcatccgtaatatcttcggattcagatgtgaaggaagagtcaatatgttctacaccgctattatcaggaaagcgtattcttctggctgaagataatgaattgaatcgggaaattgcagtagaactgctaaaagaaacttgtgcaaagatagattgtgcagaaaacggaaaagaagcagtcgagcgttttacgacttctcctagtggctattataatattattttaatggacatccagatgcctgttatgggaggctacgaagcgacaagacatattcgatccagtaatcatgcggatgcactgaatattccgatcctggctatgacagctaatgcctttcgggaagatgaagaagaggcgctggcatctggaatgaatggacatatcgcgaagccgattgatgtgaacctgctctatggaaccgtatcggaactaataaaaaagcagcatggtttgtcgtcagataaaaggaggatataatgttacgaaacatgaagataaaatccagaatgctattgtcatacggaatcataattggcatgtgcctcattgcaagcattatcgcgctgattatgctgaataagattggcaataacctatcctctttttataacaacaattatacggttaccgtcaatgtatggtctgcaagaagggaaatgcagtcagcaagaggagacattctaaatgctatactagactccgatgagagtacgaggaagaattacatagaaaaggccagcgatagccttgcagatatgcgtgctgcatttcctgttatccgtaaaacctttaaaggagacattcagctggtggatagagtggagacacttttgcagcaggcagtcgtatatcgggaccaagtgtttgaattgatagaatccggtcagggggaagaagcttaccgggtcatgaaaaacagttacatacctttgctggatcaaatggcggatacgcttcagcagatagcggatgtagcgggacagaatgcgcttgtcatggtgcaggaaggcgagcaggcgcagatatcggcggtgatcgcagtaattgtaattattatattcagcgcgatactggcagccctgattgggctacgtatctccaacagtatccgaaaacctgtagatgaaatagaacatgctgcccaggaactggcaaagggagaattggatgcagcattcgttacctataagtcggaagatgaactaggaggactatccggcagcattcgcgaactgatagattatcagaaggctgtcattgacgatattgaccatattctaagatctatgtccaaaggaagctttatcgtcagatcaaagaaagaggagtattataaaggccggtataagcgaattttaatctcgttgagagagatgcgcaagaatctcagtaatactctgtggcagataagccagtcgtcagaacaggtctctttaggcagcgagcaagtatcttcaggagctcagagcctcgctatgggcacggctgagcaggcaagttcgatggaagagcttgcaattgccataaacagcatagcatcccatgtacaagagacagaagagaatgccaatggcgcccggatacagacggatcaggcaggcgtgcaggtgtctatgagcaataggcagatgcaggagatgatgggagcgatggaggagattagtgacaggtctgaccagattggcaaaattataaaaaccataaatgatattgcattccaaacgaatatactggctttaaacgcttcagttgaagccgcaagggcgggcagagccgggcagggctttgttgtcgttgcaaaagaagtccgttctttagccgatcaagtggctgccgcgtcgaaagatacggcagaattaatagaagagacggtccaggcggtagaaaaagggaaaaaggtcgcaagcatgactgcggaatctttaataaaagttgtggaaagtataagacgggtggtatcaactgtggacaagattgctgtttcctgtaaagaacagagcaattccattgtacagattaaatcagaagcgcatcagatatcaggcgtggtacagagtaattctgccacatctgaagaattggcggccgccagtgaagaactttccagccaggcgctggtgctgaaacgtttatttggtcagtttgaattaaatgagaatctatagtttgcagtttctggaactatagacagattccaggcctaactataggaagggggcaggagtttagtaactcctagcccccaattgtcccattctctaactggataattcgatcggactcttttgccagccgcctgctatgcgtgacaacgatcacgcattttccaatttcgtgggcggtacgctttagcagatcgatgattccctctgccgtgccttcatccaggttgccggtaggctcatctgccagcaggactttggcttcgctggccagcgccctggctatggctacgcgctgctgctggccgccggataattgcaggacgctgcggttccagtcctcctttggaatgtttactttttccagcaattcttccgggttctttcgcccgcccaggatcacgttttcttttgcggtgagatagtcgatcagattgtaattctggaaaaccagagaaacatgatgcttcctgtgataatttaatccccgcttttgaatattttctccgttgtacaggatatcgccttcggtgggcgtatccagtccggccagaagcgacaaaaaagttgtcttgcctgctccgctttctccaacgatcgtataaaattttcgttcctcaaatatcagggatacgtgctccaatatttgttttgacttttgagacttatacgcataacttagatttctggcttctaagatcatcttttaacctcctaactcatctggcttaatatgtctctgggatgattcctcagaattatgatgcctgccgttgtgatggatatggcaatcaggagtgtcacccctacggcatcaaggagaatgatttcccacgtgatatcagcttgtacgtcgacaactttctgttctgcctcttcataaggctttgcgaccttcccttcgtccgccatatcctgctgctttgcctgctctatctgctgttccaccagatggtcagccataaaggaagacagaacaggcgcggctgtataagaaaggacaagcgcgagcagggagatcatgagggcctccagcagcatctggcggagaatacggattttggacgtgccgagagccagcagtatgcctgcctcctgcacgcggctattcatccagaagacgaagatcaggcataagattacaaagcttgcgcctgcgatgatccagatcaaaacattgcttatgctttgcagatcgtggaaattagatgacatcgtgtcaaggtttccatgattgtcgatcagatcatagcgctcccaattaatatccacttgctttatggcctcctttacggaagcgtattcatctacatccgccactttaaaatatgcttttgcaaacagaggattattttcgtttccttccgctttttcaggaaatcttaaatctgtaaaaataacgttttcagaacgataggtatctccggacatatagggggccattttttgccgtgtctgatagatgcctataatttccgcctcgtaaatagccgagcctttccgatcatgatagtcgttaaatgcaagattatctccaatcgtcaggctgtttttcgcggccagttcttccgagatgatgcagacatcggaatctctgcctgtgatcatccgtcctgctatcaacgacagattgccggacaagacattggaatccatagccatatcgagattgccgatcaggcttactccctggatatctgcattctgatctacgtcagcgtcttcaatccgctcaaaattcacaggatttaccgccatagtgcctgtagtaatgttgtaagcagatattccgggtacctcggcaattttccggatatcttccagcaataatgtttcaaaagaattatcggtgccggactgccagttctcggttccgtttataatgttctttttctggtaatatcctcctaagcttccttctttattctcaccgattttttttgataatgcctcgatccgcgtatgacggtttgcctcattttcttccagcaagaagcctgcgccgacagcctgtcttgcggtgtccgaggttgcgatgctggcattcttgctggccatgccagcggtaagcgagaggcttatgataaatacagtaagaagtagcaatatgctttttacaggctttcgcagaacacagcgccaagccatttgaatactattcatgattcatccctccattttggccaatgtatctttgggattggctctcagaattggaaatgctgcgatagtaaccgcgatcaagatgatcaggccgcccagcccgagcagggagagtacatcactggcttgcaaagccgtttccaaagcaatgtctggcgtagcgttgctgatgaatagcgtctgcaaggctttcgccagaaaactgcccagagcgcaggctccggcagccgccagaatcaatacggcgaatgcttctataagcgcctgcaggaagatgccgcctttgctccttcccatgcttatatagattgcggcttctttccgcctggatctcatccacatgcacagcagcagggacacgacgattattcccgtggcggtggaaaggatgagcatcagccggattaccctggcagcctggtcaaggggtgccttcaactgtttatataggagatctgaagccgtgactgccgccttgtcctgcagcattgattctagccggatccgcaggcttgcaagtttttggggatgcctcgtatagaccgccgctttgtcgtacccatggctgccaaataatttggcataagtggcattgtcaataaatatctgattttcaatgcgatgaacggaatcggtctgagacgtttgcttctgctcatttcccgatcggaataatccaacaatctttgtggtaactccagtcccatcttcggttatgaatcctatggcatctccgaccgctagaccgttagcatccgccagaagcgcgttgacaaccgcgccgctaaccgtatccgggccaatgtattcccctttcgtcagatgatactggccttccgaaaaagcgctgtctttttccagctggtcgtaagaaatgaccgcggctttttgattgtcctcattgtcggaaagactgttcgtgatagggacgaatccgtcaggcaatacgcttgcgtgggctgaacggttcacaaaagcgacatcgtcaagggaagatatctgccgcagttcttcttttgtaatccggtggtcttgatctgttatttccacaatgacctttgagcctgtctttgcctgaattgtctgttcggaatccccgaaggcgcgcagtatgatggccgcgcttaatatcatactgcttacaaataagaggacaaagaacaggagaatggattttccctttttacggatcaaatatcgaattgcaagttgataaaaagtcattctaatcaccacttcctgttccggttgcgttagccgtctgccagatcactatctttgtggctgtaatagtcccggaatcctgattctcgccaaagacaagaatggaggtctgctttttgatatcggataaggatgcaggacgaaaagcagtctctccggtagaggcatccgatacagcaatttgaacctcgcagccctcttggtactggatggtgattttttctgtctcatccatatgctccggagcagcgattatagaggtatcgccatcgtcctgcacgggagaaataatgcagccgctttctgtgaattccacgacatctccgtgcgcaagcgcagaagctgccaggctgtcgatatcgctgcctgtatcaggactttgctgggattgtgaagtggcagagtccgtttcaggccggcggtctttccccggagaggaagtctggcatcctgagagcatgactgcgcacagagcgatgaatagaccttttgctagttgagaacgtttcatgttacattccacctttcttgatgagattgtgccataattgtagtgcggatccgctctaaaaatcctctatgaccggatgcatttcagaaggctttttagaggatttttacaggattgtctgctatacttattgataccagtataattaggaagtaaaggataggatgagacatgaagatacttcttttagaggatgatttagaactgtgcacgtctattcgagcagaacttgaaaaaagcggatatgtggtggactgctgtacagatggggagaccgcgatgctctatgctctgaatgtcgaatatggatatgacctggcgatcgtcgacaggatgctgccgatcattgacgggctgaccatcataaaggcaatgcgtagaaaaggaatccgcattccgatcattatcacaacaggcatgtcggcaatcgatgaacggattgaggggctggatggaggcgcggatgactatctggtcaagccgttccatatccgcgagcttcttgccagggtaagggctttgacaagacgtccggcgaagatacagacaacggatatcttaaactatgcggatctggaacttgataagtcaagccgaaaggtatcaagtccggacaggacaataatactgacggcaaaagagtccgaattactgtatgtgctgatgcgtaagccggaaacgctatacacgagagagcagctgattttaaagatatggggtgcagactcagaggtagaattaggaaatgttgataactatatttcattcctgcggaaaagattaaaagaactgaaaagcagctgtgagataaaaacagtttatggtgccggatataaattggagaagaaaaatgttagataaattatataaaaaattaaatctgattgccgtaagttttacaatgctgatcattacaatggtgatggcgatcataggcttcaattatatcagtacggaaaaagggaaccaaagcagtttcttccagagaatggctaccttgcttatctatcagctggaagagcatccgcgggactatgaagaacttatggaagaatatgaggacaggtatgagatcgcaggcgtattaaaagacgaaagaggccggatattatatcagggccatgccgtttctttggccaatgcagacaagcagctggcagatctgcagaagcagacgattgtgcagacgccgccaaataaagaaagactcggttcgacacagcagggaggcatctatgaagttcaaggagaattccatgaaaagtattggggaatacctgcatcgatcgattccaaagaaggcagtttctatcagctatctcttatttacagacagaaaagcccgctggaaataatgaaaaaacatctgccgttctatcttggagtctggcttgcgtctttgctggggattgcctgcctgataagccttgtgttaaaaagagcctttaagccaacggaaaatgtattaaaaagtcagaaagaatttatagcatcggcatcccatgaattaaaatcaccacttgccgtaatcatggcaaatgtagagaggatcagtgacttgagcacgattgatccccaggccggcagcgcattaaaaacgatagattctgaatgcatgcggatgtcaaaactggtcagggatatgctgcttctagccgcatctgacgcaggaacctggactctgaataaggggcccgttgatgtagatacattgctgatcacgctatatgaggcgtatgaatccatctgcaggaagaatcgcattactttgaagatggatttgtcagacgtaagttacccggaactttatacggataaggaacgtatttttcaaatactgaatatttttatggagaatgctctcgagcactctataaaaaatactctgattcaaatacaatgtatggcagctggcagggaaatcacgttttatatcatagatcatgggcagggaatcgcagaggaggacaggccttatatttttgacaggttcttttgcgcagataagtcccatgcggctaagtctcattttggactgggacttagcattgctgctgaactggcaaagatgctgggcggcacggttggctttaaggatacgaagggtgggggcgcaacattttatgtcaccattccggccagatcttaattcttgcgtatgctggaattatgaactatattaatagcatgtggtgaaagattcggaagcgttgggcgcttctttgcatggcagcggctgtgaggaggaaagggatatggacagaaagataaaacatgggcgggggatggcgcagatacgcctgcttgtggaggtggcagccatcgtgggctgcatcgcctttattattcgtgtatcgaaccggctggagtcagcgggagagtcaatgggagtctcctttctttttatggctctgctttttgtggggatgtatgtggcctttttcctgcaaatattgattcatgaggcgggacacttgatatttggacttctgacgggataccagttccgctcttttgacattggtggctttacgtgggtcaaagagggagagaaaatccgctttcaaaggacagcgcttttcgaagcgatgggacagtgccagatgtaccctccgcaaataagagatgggcgcagttcctgtctgctatatcatcttgggggagttctcttgaaccttgtatccgcagccgtatttgaagtgggggcattggggcttaaggagcaccttgtcctgtccgcctggctagcgattatcgcagtatttggcgcattatcggcatttagcaatggaatcccagtcccaggcggcttggttcataatgatggatataatgcggcctgtctgtggaagaatcaggaagccctggatgcttactatattcaggggcagatcagtcggcagcaggcggaagggatccgtatgaaagagatgcccggggaatggtttgagatgccgaagcaagaagccctaaagaatggcacgattgccgtaacagcagtgcttgcctgtgcccgcctgatcgatcagatgagattcaaagaggctgggcagacgatagaaagactgctttctatggagacaggcataaccgggatgcaccgtggcctgctgaccgtcgaactgatatactgcgagctggtcggggaaaatcggcaagatcggctggaagccctgctggacgaaaagcaggaaaagtttatggcacacatgagaaagaaactgcctgtactccgtacggaatatgcctatgaactgctggcggggaaggatgaagcagaagcgaagcgtttccgggagcaatttgaaagcgctgccgccgaatatccttatttgggcgaactggcaggagaacgggaacgaatggattatgccaggaagattgccaaaatagaacagggaggttaaaagaatgcaggagatcttagtgctggaagatgaccgggaactggcagagggaatagagatggccctgataagcgatgatctttctttcacgctttgcggaacagttatggaagcaaagaagatgcaaagagaaaagcggttcgatttgctgattctggatattaatcttccggatggaagcgggctggaactttgcagagagatcagacggggaagcaaagtgcctatcatgcttctgaccgccagggatatggaactggatattgtaaagggcctggagtgcggcgcggatgactatatcacgaagcccttcagcctgatggtgttaagggcgaggatccgggcgctgcttcgccgcagtgcaggcggctcaaagcaggagtatgtaaaggagccgtttcgtttctgctttgaaactatggaattctataaggatcatatcccggtggaacttagccgcacggaacagaggatcctgtatcttcttgtcactaacgcaggcaggatacttaccagggagcggctgatggagtgggtctggccggagggaacggaatacgtggaagacaatgccctgtccgttggaatccggcgtctgagggacaagctggaggatagtccctccaagccagaatatataagaaccgtatatgggaagggatacatatggcaggaatcgcaggaactataatattactgttgagtgcagtcgcttttttgcttgcaagggattgcaggaataagaagaaagagatggaagtcttgctgcagcgtctggatgatgcgcttaatggagaagtagaagcatctgcgtatgacgaatccttggattcggcaattacagaacggctggacaaactacttagaagttccagtatgggcaaagaaagggcataccaggaccgggacaggataaaatccctgatttccgatatctcccatcagattcgcacgcccctttctaatattatgctatataccggactgctgcaggaaaagaatctggatggacaatcccggatgcttgcagataaaatacaggggcaggcacagaaactggatttcttcatgaaagaactggtgagatcatcctatatggagacggatatgattgttgtcaccccgcagacagcctcggcagaagaactgatcgacagggcctgccaggcagtagaagtggaggcgctgaaaaagaggattctgatcaggaagccagaaggggagcggatcttctgtaagttcgatatggagtggacgctggaagcggtgaggaatattctggagaatgcgctaaagtattcgccggaaggttcggaagtgcgtatagagattgctccaaacgaagccttcacctgcatcaggattcaggatgagggaatcgggataagggaagaagaacaggggctgatatttgaacggttctatcgttcccgggatgtgaagaaagagccgggaatggggatcggcctatatctggccagagagattatagccaggcagggagggtatatcgaggtccggtccgagtatgccaaaggaacctgcttttgcatctatcttcccaatttttgatgggacaccgcaggaatgtgcttcggcacattccttttctgtcagaattgtcacatttgagaaagatttgagaaagaagcatttgctatattatttccaggcgccggatggcgcgaatatagaactatggaggtacaatatggacatattggttacagagaacttaaagaagtactaccggatgggagaaaatgtagtaaaggctttggatggcgtcagtctttcggtccggcaaggagaattcctggcgatcgtgggtaagtccggaagcggcaaatccacgctgcttcatatgctgggaggattggattggccgaccagcgggaaggtgatgattggacagaaagatatatcttccatggataaagatgaacttacgatattccgccggaggaagataggctttgtattccagaactataaccttcttccgctgatgaatgtatatgagaatatcgtccttcccatcaagctggacggcatccgcccggaaaagaggcatgtcaatgagattatcgaaatgctgggccttggagacaaaaggtctgcaatgccctcccagctctccggaggccagcagcagagggtggcgttagcaagggctctggcagccaagccggccatcattctggcggacgagcctaccggcaatctggacagcaggaccagccaggatgtgctgggactgatcaagacttccagcgaacgttttgggcagacggtggtaatgattacccacaataacgagatcgcccagatggcaggcagaatcatccggatggaagatgggaagattcgcggaggtggcaaggcttatgacgaagattagtaatagaaaggtgatatctcagattgccgccacgacctataaggcaaataagaagcgcaatgtgcttacggtatttgccatcatacttaccacatttttgattggcgtggtatttgccgttggcatgagttactggaataccatatcccttcgccagatgcgcatgaacgggatggattacgacattgaactgaccgagcccaaggaatcacaggttcaggcaattcgagccatggataaggtaaagacggcaggaatatcggtcaaatgtgcaatcgtagaaaagtaccaggataaggaactggagaagatccagatgtactggctggatcagacagcgtggaaggagcagtgcattcctgctcttgagtcctatgaaggtacctatccaaagaaaaagaatgagattatgctgtcgtccgatgccttacatgccatggggatagcagatccaaagccgggaatggcgatcacgctggaatatttcatgctggcagatgagaatgaaacgcaggattctgagcaggaagaatttatcctatccggctggttccgggattattccggaagatccagaggacttgtatccagggaattctatgaccgatccggggcgagccagacggatctgacccagggagaactgctgattaccttgaaaagtcccatatattccaagaaagacattgtggatatgcagaatgtcatctcccttggagggatgcagtctctgcttgctgactatgacacgatttccaactttctgaagacagcagctatcctgctggggatgctggcgatgattctattcagcggctatctttttatctataatatgctgtatatatcaatctcgaaggatattcaatactatggacagttaaaaaccatgggcatgacatcgggacagatgaagcggatgatcgcaaaggcagtcgtatggaactgcgctatagggattccgctgggactgctgcttagcctggtcgtttcgagaggcgtgataccgcagattctgcaaattgtgaatcctactttgaatgcggcggaaattaccattatcaagccatggatctatctactggctgcagcctttgcgttccttacgaacctggcaggcagcaggaagcctgcaaagatcgctggagattgctcgccggtggaggccatgcgctatattccggaatcaggagagagaagaaggggaggagaaagggacgcggggataggcgctatggctgtccggaatattacccgtgacaagaagcaggcggtggtcatctacgcttctttcatcgtggcagtgaccgtctttttgattatgaatataattgttagagagaatgatgccaggagcattctgaatgccacttaccaatatgacatacgtttcaagaatgagactacattggaggatcagaagccattgctaacagaggaaaagattcgggccgtccgtgaaatcagcggagtaaaaagcgtagaaagcgtgacttcgacagaagcagttattccataccagaaggaggtctatggagaattctataaagaactgtaccattccagatacacgccgagcggcgattatgaagtagatatggaatcttaccaaaatgatcctgcgggcagccggtttacgacgcggcttgtagggattgaccaggcacaattcagaagaataaataaggaactgggcaacgcgttggatgaagaggaattccgggaaggaaagatcacaattttagaagatttcatgcagatcgatatgggcgatgtgatcggaaagtctgttgcattcaccctcccgaatggaattctgccaagccaggaatacaatgttcggattgctgcaattacccaggactcacctgaatattttgcaggaggctataatccggtaatgatggttagccaggagtatatgaacaccctcatgggagagccattctgcgagctgattcaggtaacctatgacgagccatttaccgggaaaacggagaaagaagtaaaaaaagtattcgaaggtgagacgcagattacttatgattcaaaactggaacgttatgcggagatgaaaagaacagagacgcaggtgaaggtattgggaaacagcgttgcggccatcatggcgctgctggccgcgcttaactactttaatatgatggctgccagcgtgcagaaccgttccagggaatttgccacgttagaaagcattggaatgacctcgaagcagatcaggaagatgctggtcttggaaggaaccggatatgcagtggtatcgatcattatatccgttatcctggggctgcctttaagttatgccgtatttgaggggatgaatatctacaggattgactattctatgccgtggccatgcaatctccttttgtttgccggaatccttatcctgtgcatgaccgttccggcggctatctatcagcggacgcaaaaaaacagtatcattgagcgtcttttgtgctaagatatagtcaagcataacaggaggtggattactaatgatcagaatagaaaaagaaaagtgcattggctgtggcgcatgtataaaggactgtccggcatcggcaatcaggatgacggaagaaaaggcggaggtgtataaagactgcctgcactgcggtcactgcgtcgccatatgcccgtcggaggcagtctctatcccggagtacgatatggaggaggtagaagcatatgacaaagatgcctttacgctgaaggcggaacattatcttcatgcagtaaagttccgcagaagcatccgcaatttcaagccggttaagattgagcgcgagaaggcggaaagaattcttcaggcaggccgctatactgccaccgccaagaaccggcaggcgtgtacatacgtatttatccaggagcaattggaagagttcaaggatctcgtctggaaggaaatgccgtccatcttggaggaacttaagaaaagcgccccggattacgccagggcattcgaattcttttacctaaaatggaagaaaaatcccaaggacgatacctttttctttaatacgcctgcgtttcttgtcatcgcttccgacaatcctctggatggaggactggcggcagccaatatagagaacatggctgtagcagaaggcctgggagcgctgtatagcggctatatgatgcgggtgataggatgcagtcaggcgctgcgggaatggcttggaataggggagaagagagtttcctgctgcatgctcctgggctatcccgctgtatcgtataaaaggaccgcgcccagaaaaaaggcggatattatctggaaataatcttcaaattttttggtctttcagctacagaagccgaaagacctgttctacggaagcgcgcatattctcccgggcattctccggcttcatggcttcctcaagcgtggtaacgccccggatgatggggaagaacgcgtcaataccggcctggttgcaggcagcagcgtccttggttacgcttccggcaaaggcaaggactttcgcgttatattttttggccagccgggcaactccgacaggagcctttcccatggcggtctgatgatccagacggccctctccggtgacggccacatccgcgttttttaactcttcttccagccccacggcgtccagaatcaggtcgattcccggggtaagtcttgcattcaggaaacttaggaaggcaaagccaaggccgccggctgctcccgcgccttctgtttctgcgtaactgcagccgaaggtatcggcggttatctgcgcatagtgcgccattgcctggtccagtggttctttctgcgcatcggtcacgcccttttgcggcccatagatgtaggtagcgccgtttttgccgcagagcgggtttgttacatcgcaggccacttggaaattgcattcggcaagtcttggatttgttctggtactgctgatggcggcaactttggagagcgcctgcgcgccttctcccacatcatttccctgactgtcgagaaatacgaatccaagcgcctttagcatgccgatgccgccgtcattggtgacgcttccgccgattccgattataaagttccgacagccttttttgatggcatcgttgatcatctcgcctacgccgtaggtggtggcagccaggggatcctgcctgtccgtgggaacaagcgtgattccggcggcagaagccatctcgatgatggcggtcttcgtttcttccaagtatccgtaatatgcttggacctttgttcccataggcccggtgaccgtaagatcgacgcgctcgcctttcattccttcgatcaaggcatccgtggtgccctctccgccgtcagccaggggctttacaatgacttctgcatccggcctggcggcaaggattccctccttgactgcaataccggcttccatggaagtcaggcttccttttaaggaatcgattgctacaacaactttcatttctttgaacctcctgtgtctgttatccatttcgatactttgttaaggcgagtatagcacatcagagtcaaatggaaaatgttccccgagacaaaaatgagacgaattagttaggaaatatgttacggagtacaatatttcgcgaatatttactcaggtatcgtatactttagcaatacggccagatacaaaagaacagaatccttaaagtcccggggattcaatccgctgatccggtggatgcggtcaagtttatactgcagcgtatttttgtggagaaataacttctcgcttgtccgtaacagggaccgcccttcctcaaaatagacacgaagcagttccttctcctcttccgagagaagggacagcgttttagccagaaatgcttccttgctcctggtacttaaggaggcaagcagaatctccagatccatgtcatcaaacaggacgaaaggcttatctgatgatgcgctttttagggcgatctgtgctgtggagtaggaatgtgccagatgaagcagatggtccgcgcagccgacgccggcagataatatatctgtgttggaatctgcgaagcccttaagctgcgcctgattctgttcgaagaccggctcgtccaggatgccgacgtattcattgggatattggaagcaataaagggatattttaagccggtcgaacatctggcaaagcttcatctcggcagaggatggcacggtagcattggcagcgggatggaggcggtagagcagaacccgtttcttaacggtcctgtctatgcgaagttctgcgagcagttcttctatgcgggacagttcttcggtcccaagttccgccggattttcagatagaagcacctggatcagataagatttcttttccgtcagcgtgcgtgcagcagcattgacttcctgttcccgtatcagcaggcgggtgatccgctccgccagataagcgtatttgcgtacggactcgggctctccgctgattccgatgacggcaatgaaggcgccgtcatgggagatggggatattcacgcctttgctggtgccttcataattgtcttcctcagccacttcgatggctgtcatggtatctgcggccttttttccgatctcatggaatgtgccgattcgttcctcgttcgtgctggcaaatattattcccttccggttgatgaaattaatgtcatgcccgcagatatcctgcacggtattcacgatctgctgggcgagagtgcggctgacggtagtgatcataagtttctcccttccttgctattatcctgattataccgcctttgcctcatggttgcaatcaataaggcggtcattagatattgcaactgcgataaggcggccttataataaggacaagcaaaaagcgcccatgatatcaaagaatccaggaaagagcaggtgaaaatagtatgacattttatgcgatcaatggaagcccgagaaaaagaggaaatacggcagttttgctggataaggctttacaaggagtgaaagatgtaatcccggatgcggatacgaagataattcatgtatatgattattcctacacaggatgtgtcagctgctatgcctgcaagcgaaagggaggcaagtattatgggcggtgcgccaaaaaggatgcgatctcttcgcttctgccggaactctcgcaggcagatgggcttatcatagggtctccggtatattttcatagtctgacaggccagctgcaggcttttctggaaaggctgctctatccatacctggcgtatggaaaggaatattattcgattgctcctaagcacatgccggtcgcatttgtatatacgatgaatgccacagaagagaaagcacaacaaatgaattatcaaataaaactgtcgccgatggaagaatacgccggagtcgttttttcacctccggcggttctgtactgctatgatacttgccagtttgatgactacaagcgatatatggcacaacggttttccgaagaaaagaaactacagcgccggcaagagcattttccaatagactgtgaaaatgcccgtggaatggggcgggcaatggcacaaaagattacaggtcagaatcccactgccgaaggaagtcctggcagaatttgatgaactcaatctggttggcgtgaaaataactgttgtgcagcgataccagattataggcatgaaattcataataattctcaataaagatctgctgcaggatgccctcccgcagttcggaggcgacagcgctcttgtataaaaaagagatgccgatattgtgcagcagcaattgcttgaccagcggaaggctgttgttgatctcgatatggttatgaaaatggatggtggatatatgattatcccggaagatggattccagccgtttcctggagggagtcttatctgcgcccaggatcagggtgttattatagacttcctctatggggacggtttttcctgccagcggatgcatggacgagcatacgcagaccacgctggaatggtataattcgtaataatcatgttccgtttttgatacgatgccatccataagaaagaagtccaattctccatcgttgagcatctgcgaaagcgtattatagttatctgttacaattctcatcctgcaatcaggatttttttccaaatatgaaataatcaaataaggcagaaaagattctccagcagactgctctgcccccaggcgcagcatggcggaagcggaattggattgccgcagctgttctttgatccgttccgaatcggtatagaaagaactgacgaactgatacaatacctcgccggaggtggtcagatggaactttttgcccacataagtatagagttttacattgtagtattcttccaagtacttgatatggtgggataccgcgggctgcgtaatgtgcagttcttcggcagtctttgtaaaactctttgtctggcataggacaagaaatgtaaaaaatcgtgtgtcaagcataggactcctccaatattattctgagtaatagttgaattacgaattgtaattttattgtaatggcaaaagatgatataatcaagcataagttagaataatcggaaagcacttctaaaaaacggaagaacaacacgaatagtgcgactacttccggcgattcaaacaacatactataaaggaggagaatgtatgaaacgattttgggcaggtattttgtgtgtaaccatgggacttatgctattgaccggatgtggcgggtcatcatctgattctggaagcgcatcaggaggatcatccgcgggcaagggttcggacgacggagagggggttgtcagatatactttgacatccacgcctcagatcgaccctggcgtcggatcagatctaggagccgcaaccgtgctgatcaatgtatatgatccattggtaatgcctcaaaaagacggcaatatcgagccttggattgcaaaagagtggtccgtatccgaagatggcaagacctggacattcaaattgagggatgatgtgacattccacagcggcaatccgctaacagcgaatgacgtggcgtataccatgcagcgccttctggatatgggagagggatttggatacttattcagttccacgatcgaggcggtcaatgtcattgatgatacgacggtagagtttgtctgtacaaggcctacgggaacgcttcttgcatccctggtcaggctttacatactagacagcaagctggtggcagaaaactatgcatccggagattttggggacaaaggcgattatggaaaagcgtttcttctggagaacgatgccggatgcggaccgtataaggtaaaagaatacgcggcaaattcccatgtactatgcgagcagtatacagactactgggcaggactagataagaacgcgccgaaaggattcaaggcaatcggctccaatgaggcagtaaccgtcaagaccatgatggaacgagacgagttggaactgtcggatgaatatcagacctctgagaccatcgaagcgctggataagatgaaaggcattgacatcatggagaccacaagcggagatatcatctatcttcttcttaacaattccaaggcgccgacggatgacgagcatatcagaaaagcattggcatatatgctggactacgatgtggtatgcaatcaggtatatccgaattctaagaaggccgatagtattatttccaagaatcttctgggacataagaagatgacggactatagctttaatattgagaaagccaaagaggagatcgcaaaatccaagtatgcggataatattcaggattatccgatcgaggtgtgctgggttgccgagactccggaccgtgagaaattagcgcttctgatccaggctgcggcagaccagatcggagtaaaggtaaatgtcgtaaagacgccatgggcaagcgtagtagagaagtcggcatcagcggagacgactccgaatgtgacgacgacatggtttgcgggagattattcagaggcaggagcaatatttgattcggcactaagttctaagaatgcgggaacatggatgaattgctgctggataaatgacagcaagctggacgaaatgatcgatgatgccctgacaacccttgatacggatgaaagagttgcaaaatatgaggcgatccaggactacctggcggataaatgcgtgatgatcccgatggctgaggttacgctccggctggcttaccagtccgactatgtggaatacaattcagcgaatcctgagaatttaaggccagtcatgggctatatcaactatatgcctgacatcaggatctatccggataagaagtagtgaacgtcaaaataggagaggaggatcagggatgtcactcctaaagagtatattaaaacgtttggcaagttccatcgtcgtgctgcttggattgaccattattatatttatcctgatgcggatcgtaccaggggatccggcaaggctggctttgggggcaaatgtttcggaagaagtactggaaaattacagggagatcaatcatttaaatgattcacttccgatgcaatacgtatattggatatccggagccatccggggcgattttggaatgtccgccgtgacaaagcgggcggtcattcaggatatcaaggattttgcgccggcgacgatcgagctggtgctctgggccggcttcccgtccattctggtcgcgctgtacctgggagtcaccagcgcgcagcataagaacaaatggcaggattacttgtgccgctttttaggatacatattcgtagccacccccaccttcgtgtttgcggtgattttcctgctggtgttcggctactggatccctgtgctgcctacgataggaggacggctcagcccgtcctttactatcccggatatcacgggactgtatgtgctggacgcgctgctgggcggacagccgaaagccgcatgggacgcctttctccatcttctgttccccgccctttcattggctttggggaagacgatgcaggaggccaggattaccagatccagcatgctgcagaatgcagataaggattatatcacgatggtaacgtcccagggcgtgccaaagtcggtggtgaacagacggtttcttctgaagccttccgtaattcctacggtaacggtggtaggaatggatatagcggccatgttcggcaatgcgttcctggtggaacggatcttcaactggcccggcctatccagctatggaatgacggcgatacttaataaggacacgaacgcggtctgcgcggtggttctgatcattggcctggcttttgcgcttacaagcatagcggtagatatcgtggccatgattctggatccgagaatgagacagaagcgtacgcggtaggaggtggtgtaaatgaaagcagagcgaaaagaaacgatgataagaaactggtacaagttttcttctggcggggtatccgtgatcgggcttgcgattgtagtgctgattatagtgcttgctatctttgcaccagtgatcgcgccatatccgcaggatgtgggcgcagtggtgaattttgaggaaagttctctggctccaagcatggaacatattatgggaaccgataccatgggacgggatgtattttcgagattgctgatcagcttgagaagcagtctgcttatggggattctggtgctgtcgatcgctgtgccggtgggatttgtcgttggcgttttggccggatattacaaggatacctggatcgaaacggtgctgatgcggatcgtggatattttcctttcggtaccggcactggtacttgcgcttgcgattgcggcgatattggagccgaaccttcgcaattccatgatcgcgatcacgatcatgtggtggccgtggtatgcgaggctgtcctttggagtcgcgtcttcgcttcgaacagagaattatattgtatatgcggaactgacaggcgcgaagttaagccatattatcttcaaagaattcctgccgaataccttcgaccagattctgactaagatgacgctggatatgggctacgtcatctgtatgggggcaacccttagctttgtaggtcttggagagcagccgcccaccccggcccttggcaatatgatcaatgacggcgtgaaattcctgccggatatgtggtggcttgcgatcttcccggcggcgacgatcatcattatcgtattgggcttcaatctgctgggtgatggcgtaggcaatatatttaatgtggagggcaaataatggaagaaaaggcaaaagtattagaagtcaaagatttgtccgtatcctatacagtcgcaaatgtaaagacgcacatattagaggatgtttcctttgccgtcagcaaaggaaagagcgtagggatcgtcggggagtccggctgcggaaagacgacgacgatgcgcgccatcctgaatgttcttccttccaatgggaatgtagaaaagggcgagatattatactgcggcgaagacgtgcttaagatgtccaatgccaaactgcaggaataccggcaaaaaggcgcgggcatgatctttcaggatccatccagcgcgctgaatccggtaatatccataaagaaccagtttttagaggccttgaaatacgcccacaaggataagaaacttacgaaagcgcagctcttagaaaaagcagggaaatcgctggaagccgtatctcttgccgacccggagcgaattctgaacagttatccgttccagttatccggaggaatgaggcagcgagtgtgcattgccatgaccttggctgcggagcgccagctgctgcttgcggacgagccgggaaccgcgttggacgtgacgatacaggatcagattctcaggctgatcaaacagctggtggattccggggaactgtcggttatcatggtgacgcattctcttggagtcatacgccaggttacgacggaagtcaatattatgtatgcaggcacgatggtagaaggcggggacaccaaaaaggtatttgagcatccgatccatccgtatacagaggcgctgatgaactgcctcccgaaactgacaggaaacggaatcgctgaaggtatccccggaaggattccggactacagcaacccgccaaaggggtgcagattcgctccccgctgtccttatgcgctaaagaagtgccagaacgaaaggcctgtccgccatgaagttgacggggatcactgggtagcatgctttcaagcagaggaggggagatcatgagcgaagtaatattggaaatcaaagatttgaagaagtatttccctctggccaatggtaagacagtaaaagcggtagacggcgtgagcatgaagatgtataagggagagacgctggggctggtcggagaatccggatgtggaaaaagcacgattgcctatacggtagtcgggatgtatggagcaacctccggccaggttatctatgacaatatggatattgtaaagaagggatatagaagaaccctgaagcaaaaaggcgatatacagatcgtgttccaggatccgggatcttccctgaattcccggcgcacgattgagaagagcatggaagtgccgctggatatccacgataagatgagcaaagaagagaaggagaagcgcgtcgaagaattgctggaaatggtgggccttccaaaagactataagaacaagatgccaagaaacatcggcggaggcgagaggcagctggtttccgtagccagggcgctggcgaccaacccggaactgatcattctggatgagccgacttcagcgctggacgtttcagtccaggcaaaggttatcagtacattgatagaattacagaagaagctggaactgtcttacctgtttatcacgcatgatctgagcctgatgcgcaacgtggcatcccgtgtggcgatcctgtatctgggcaggctgtgcgagctggcgccgacagcggagttcttccaggcgccgctgcatccgtatacgaagatgctgctatcctccattccggtagttacggaggaagaggaggcgatgaagccagatcagatcgtgtcccagggagagatcccctctccggtgaatgcgccaaaaggatgtacctttcacaccagatgcaaggactgcatggaaatatgcaagacaacagcgccagtaatggtggaagtagcgccggagcatatggtctgctgccataagtatacggcgcaggcaatcaagaaagagggggagacggacgtatgataagcggcgatttgcagaaagcggcagaggttctggtaaacgttctgctgaagactcaaaaaggagaaaccttcgtgatcacggcggatacggctgtggatgcgtcggtaattgaagtaattgggcgggcagccttcgctgcgggcgcaaagccactggtcgccctgattcccacgccaggaggggtcagcctggcagcagatccagatattcaggtagaaggcttgagcggtatgatctccaaagcggatgtctgggtggagctgaatgtgaaatggctgctgtattctactccattttacaatgccaaaaaggccaatccaaaactacggcatatgtgccttacgggaaccaacgccgatacactgatacgctgtgtcggaaaagtcaactatccggcgatgagaagattttccgagatcctgcgtgaaaggatcaaagaggcccataacgtgcggatggtctcccaggatggagatgagattaccttcgtcaatgtgccggaccgccctgtttcctgcaaactgggcgatgccagcgtgccgggaacacatctgttcgtaggccagatcggatggactccgatgctggagagcgtaaatggcacgatcagcctggacggatcggtagcgccggatattggattgatccagagtccggtaaaaatagaagtaaaagatggctgcattatctcgatgtcaggtggagaagaggccaaaaggtatgagatgtggcttaagagcttcggacatccccagatgctgcgcatctcgcatgccggcattggcttccatcccggcgcgaaactgatcggagacattctcctggatcagcgcgtgtggggctccaccacgtggggatttggaagcatcggcgcaggaatgctgcctccagacggagtctacgcgccgtcgcattcagatgcggtttcgttaaatacagatatctatctggacgatcagccattgtggattcacgggaatcttgtggacgaggaattgaaatcattcgaaagtgaattgacagcgttaagataggagggagcataaaaatgggagagttcttatacgaatttgaactaggaaaagcagccgatgtgattgtaaaagaattattcaaagtaaagccaggcgaaaactttgtgattaccgcggacagcagaagcgatgaacgggtggtaaacgccaccgcgcgggcaatctatgccgccggggccaagccgatggtgatctggacggctacgccgccggggccgggaaagcaggtggatgacttcctgccatccggggcgatcaaggcagccttgatggaagccgactgctggattgaatacaatacgatgtacatcttatattcggatacctatgaggaagttgcgcatacgaataagaagcttcgcttcctgtgccttccgggcatgcacgtagacgttttcatccgcctgtttgccaatacagaccatgaggcattgcgggatctattgcacgcggtaagggataagattcgctcggcaaagcatgtaaggcttaccagtacggcaggagaggatatcgagtttgacaatcatcccgattatccgatcaatgcaagagatggctatgccgatgagccgggaaccttcatgctggcaggaatgatctcctggaccccggatctggataccgtaaatggagtgattgcaattgacggctctctggtgccgcagtttggcgtattggaacagccggtaaagatctatatgaagaacggcgtgatcgatcatgtggaaggcggagcaatcgcagagcagtgggaaaaatatatgcgggacttccagcatccccagatgctgcgtccggcccacgtttgcgtgggattccacccgaatgcaaaacttacgggacagctgggagaagatgagcgcatctatggaggctcccagtggggctttggggcaattggtagcttcctgatgccgccaaatggtatcccggctccgtcccatatagacgctacctgcctcagagtatccatttatctggacggagtggcgattacgcaggatggcgagatcgtagacgaagagttaaaaaaatatgctgccagattaggcagatagataaaaagaggttaatgcgtggaaaaaatattagaggaactggtggagcaatatcgggatgagattgtggaaaccaccaaaaaattaatcgcccttccgagcctatacgaggaaggaaacgaaacatatccatttggagagccaatcggaaaagcgctggaaaaggttcttgagatatccgaagaaatgggatttgaaacctgcagccatgacggctatgtaggcacggtcaaatggggcaatgaggggaagcagatcggcatcctgacccatattgacgttgtccctcccggggaggggtggacatatccgccttttgagggaaccatagaaaatgggaggctgtatggaagaggctctctggacgataaggggccgatggccgcgtcgctttttgcgatgaaggcgataaaagaaagcgggcttccggtaaaaaatcatgtgtgccatattatcggaacagacgaagaaagtggtttcatgagatgcctgaagaattatctggaaaaggagccggctccctggggcggattttcgccggatggggaatttccagttatccatgcggaaaaagggatccttaggttctatgtgacagaccgctgggagaatacgaatgacgatgacgggcttatcctggtggaagtcggcgggggaaccaaggtaaatgtagtgccggcgtttgcgtgcgcgcttgtacgcggaggcgaggatgcgcagggggtattggaacaatgccgggacgcctttgcggacaaagataagatatcattcgagccagaagacggtggatggagagtaaaggcaaaaggaatgagcggacattcttcacagccgtggaatggggacaacgcgattaatacgctgcttcggtatttgctgtcgcttccccttcgtgaaaatgggcagatgctattcgcgtctaagattgcaggcctgtttggcgacggctatcgcggagaacgtctgggtgtggcatgcgaagatcaattatccggcattctcacgctgtctctgggagttcttaaaattggaagcgaggatggaaaggccacggtggaaatcagatatccgatccatgcttcagatgaagtcatccagaagaccttgatggtggcctgccaggattccggggtggatatagagatcatacaggataaaaagcatatctattatccggtaaaggcgccgctggtgcaggaacttctgaaagtatatcaggaaaccacgggaagaacggaagcgccagtcgtgattggcggaggtacctattgcagggcggtagataattttgtcgcatacgggcctgtatttccgggacagcgggaactggcgcacgagccggacgagtatatcggcgtagaagatctgatattgacggcgaaaatctatgcgcaggcgctttatgcgttattgaatatgtaaagccggatgggacaggaggtctgacgatgctgaaaataggattgattcaactggcggttatggaaggcagatgccaggaaaatatgcttcatattaaagaacttgccaagaaatatgccaaggatgatgttgacctgctctgttttccggaattgtgcgtcagcggatatgattttgaaaaagcgcagcattgtgcaaacgaggcggagttcttttccgaacttgccagagaatgcaatactgcgatcgccgccggcattcatgtagaagaagagggccggcattacgatgcggcctgcctctttgacgagacggggacccttctgggagagtatcggaaaatccatctatgggataaggaatgtgaattttttgagcgtggggacagccttttggtgataccgtttaaaggatggaagatcgggcttctgatctgcgcggatatgagattcttcgagatatctaccccgcttaagaatatgggggcagatgtcatcctttatccaagcgcatggattgcgggctggaaagaactgcttcacttatgcggcagaatgcgcgcggccgagaaccagatctatacgattgccttaaaccgggcttctggcgacgtggcttactgcggcggaactgcccttatgggaccggatggcagtatccggagcatgctggatcatgatcaggaggcgtacctggaagtagtgctggaaaaatcccagatccaggcggcaagaaacgcgctggaatgggaaagcctgaaatttccggagatatatcaaaagtatgaccaatacaggttcatgaaacgaaaggagatatgaaaatggaatggaacataggcgttgaaatgagaaatgaatatagaagaatggaacttgcccgtgcggcaatgaagctggtaagggatatcatgctgtgcaagccgggcgagaacctggtgatcacgtatgacacctgcgtagatgaaagagtcgttcatgctttgacagaggcagcctatacgattgaaagcgttccaacggtcatctattatccgactgcggaaggcttctatgcagacccgccaaagccggtggccgacgcgattgctgccgcggacgtgtggatcgagctgacctacgcttcgatcatgcatggacctgcatatcgcaaagcagtggatgaaaatggcgcgcggtatatctgcgctacgggcctggatacggagatgctggtaaactgcatcggaaagattaatgtagataaagtcatcgagttaggagaatattttaaataccgcctggaaaatgcccaggatattcatgtactgaccaaagaaggaatggaccttcgcgggaacatgggaggacgcaaggttcgacactccggcatcaaggcaacggagaaaggctatccggtaatgctgaccgggcagaccagctggtgccccatcgaagagtcgatcgaaggaacgctggtatttgacggggccgtattccccccggattcgctgggaatcttaagagagaagatctttattgaattcaaagaaggcagagtcgtggatgtcaccggcgggccggaggcagagatatacaaaaaatggctgcattcctttgacgatccgaatatgctgcgcctggctcactattcccagggctttaacccgggagtgcgtaaagtgaccggccgtatcgtagaagatgagcgcgtgtttggctgtatggaatttggaatcggaagccagggcatcaagattggcggcaagcactggagcgcggcgtcccattccgatggcatcgttcttcatccgaccatcatcctggacggggaaaaactggaagaagacggcgtgtatgtggatgagacggcatgcaagctgtgcaaagaactagggatcgctggatattaaggcggatacatagcctcagggagagaacatgaagcgtaaaaaaaagatattatttcttaaggcagttgcctatggcgacttaaatgaagagataaaaacctatttggaccagtataaggacgagacaaccgaactggaagtaaggaatatccagatcggccctaagcatctggaatatcaatactaccaggcattggcaggggcacagatactgaaagaagtactaagggcggaaaaggagggattcgatgccgcctgcatcagctgcttcgacgatccattcctgtatccggcaagggagatcagtaaaaatatggtggtaaccgcgcctggagaggcgagcatgcatctggcatccgtacttggaaattctttctccatcatcgtaggaagagataaatggatcccgcagatgagagaaaacgtatgcaaatatggcctggaaaggaagcttgcttccttccgaagcctgggcatgggcgtgctggatttccacaaggatgaaagggctacgatggagaagttccggcaggaaattcgcctggctatagaaaaagaccgcgctgaagtgatcattctgggatgcagcatgcagtttgggttttacaaggaacttcagcaggaatttggcgttccagtgatcgactgcatgatcgccagcctgaagcaggcggaatatctgctggaactccgggaaaaggcggggtggcacttcagcagaagaggattgtacgaaaggcccgacccagaagaaatgcgtgattggcagttggacgagtgttttaacctggaaggtttgcttgattagtgcctgtattgatgttacaatttaaaaaaatgattttggcggtgatcgttatgcttagatgcaagaccaaatgcaacgatggctggctccatgcaaagccagtataaggagcaacatttgcatggagtaggaattggttgcgaacttaatattgctggctttgctgcttgactatttaatcaaggaggaggcctgcatcatgaagtatattaatgcaagcacgattctcccggacgagctggtcgaggaactacagaaatatgttcaggcaggttacatatatattcctgcaaaagacgagcagcataagaactggggcgaattgtccggctatcggaaggaacttgcgagacgcaatgcgttgatcattgcggagtatcgcagcggcgcttctatggaagaacttgcaaagcgttattccctttcggtctatgccataagaaaaataatatatcagaaatgatacatgggagggctgcttataggcagccttctttttgtatacggaatattgctgtatcgtttcgtatattgtggacgtgggcgcgtgcaagtatgataggaaacaggagatgtctataagtatacattcatacggaacgacagacattaaaacaaaggactaacaggaggattttataatggctacaccgacaaaactatatccaagaacaggcgacaggcagacgatctatctgaaaaatgcgatcacagaccctaatattcaggttggggattatacgatgtataacgattttgtgaatgaccccgcaaaattccagcagaataacgtattgtatcattatcctgtcaatcaggataaacttattataggtaagttctgctctattgcctgtggcgcgaaatttctatttaacagcgcgaaccatacgcagcgttcgctgtctacctatccgtttcctttattctttgaagaatggggactggatataaaaaatgtagcaacagcgtgggacaataaaggcgatattataataggaaatgatgtttggattggctatgaagccgtgatcatggcaggcgtgaccataggagatggagcgatcataggtacgcgcgcgattgtaacaaaagatgtgccgccgtatacgatcgtgggcggggtgccggcaaaacccattcgcaggcggtttccggatcaagttatttctacgctattggaattggaatggtggaactggcctgcagaaaagattgcggagaatatagaagcaatcaagactggggcttgggaagaattgagataacgattggcgtagcgatggactttcgcctcatttaacgaaacagtccatttttttaaagaattagcactcgactattgacagtgctaataaatactgttatagtactcgtagaacaataaaatgcagttttctagatgaaggaggttcatcgctatgaatataaataaatttacgcaaaagtcgcttcaggctgtccaggactgcgagaaggtggctctggaatatggcaatcaggagatcgagcaggaacatctgctgtacgcgcttctggtacaggatgacagcctgatcttaaaattgatggaaaagatgggcattgacaagaatgccatggtcaatcgggtggaggaggctatccggaagcgcacgaaggtgcagggaggccagcagtacgttggccaggatctgaataaggctttgatccacgccgaggatgaggctaagcagatgggggatgagtatgtatccgtagagcatctgttcctttctatgatcaagtatccgaacaaggagatcaagacgatctttcgtgagatgggaatcaagcgggacgccttcttgcaggtattgtccacggtgaggggcaaccagcgggttacaagcgataatccggaagacacctacgatacgctgaacaaatacggctcggatctggtggagcgggcaagagaccagaagttagatccggtcatcgggcgtgacgcggagatccgcaacctggtccgcatcctgtcccgcaagacgaagaacaacccggtgcttatcggcgagcccggcgtcggcaagacggcggtggtggaaggcctggcgcagcgcatcgtgcgcggggacgtgccggaagggcttaaggataagaccatattttccctggacatgggagccctggtagccggagccaagtacaggggcgaatttgaggaacgtctgaaggcggttctggaagaagtcaagaacagtgacggcagaatcatcctgttcattgacgaactgcacaccattgtgggcgcaggaaagacggatggagccatggatgccggcaatatgctcaagcctatgctggccagaggagaacttcactgtatcggcgccactacccttgatgagtaccgccagtatatcgagaaggacgcggccctggagcgccggttccagccggtcatggtggatgagcctacggtggaggacgcgatctctatcctgcgtggcctgaaggaacgctatgaagtattccacggcgtgaagatcaccgatggagcgctggtcgccgcggcaacactgtctgaccgatacatctcggaccggttccttccggataaagccatcgacctggtggatgaggcctgcgcactgatcaagacggaattggattccatgcctgcagagctggatgagatgcagcgcaagatcatgcagatggagattgaagtggcggcccttaagaaggaggatgaccgcctaagcaaggagcgtctggagcacttgaaccaggaactggcagaactcagagaatcatttgccggaaagaaggcccaatgggacaatgagaaggttggcatagaacgggtacagaaactgcgcgaggagatcgaacaggtgaacaaagagattgaaaaagcgcaacaggcctatgacctgaaccgggcagcagaactccagtatggcaggcttcctcaactgcagaagcagctggaggaggaagagacgaagattaaggacgaggatcgttccctggtgcatgagagcgtcacagatgaggagatcggaagaatcgtctcccgctggacgggaatcccggtcgccaagctcaatgagagcgagcggagcaagaccctgcatctggcggatgaacttcataaaagagtgatcggacaggatgaaggggtagaactggtgaccgaagcaatcatccggtcaaaggcaggcatcaaagacccgaccaagcccatcggctcatttctgttccttggacctaccggcgtaggaaagacggaacttgccaaggcgctggcggagagcctgttcgatgatgagagcaatatggtgcgtatcgacatgagcgagtatatggagaagttctctgtatccaggctgattggagcgcctccgggatatgtcggatatgacgaaggcgggcagctaaccgaggcggtccgcaggaagccatattccgtggtcttgttcgatgagatagaaaaggctcatccggacgtattcaacgtactgctccaggtgctggatgatgggcggattaccgattcccaggggcggacggtagactttaagaacaccatcctgatcatgacatccaacatcggctccggctatctgctggacggcattgatgatcatggcaatatcagcgaggacagccagcaggcagtcatggaagaactgaaggctcatttcaggccggagttcttaaaccgtctggatgaaatgattatgttcaagccattgacgaaagataatatttatgacattattgacttgttagtagcagatgtgaatcagcgtctcgcggagaaagagatttccattgccctcactgaagcggcgaaaaattacgtggtagaaggcggctatgaccctacctatggagcaaggccactgaagcgctacctgcagaagcatgtagagaccctggcggccaggctgatgcttcaaggagacgtaggcgcgcaggagaccattgtaattgacgctaaggacggcagattaacggcaaggagccagtcattgtgtcaataatatttcatatcgacgtgaattcagcttaccttagctggacgacaatagaagagttaaagaatggaggagaggtagacttaaggacgatcccggccatcatcggcggggatcagaagtccaggcacggcgtagtgctggccaagtcgcctcttgccaaacagtgtggcattcggacaggggagcctgtcgcgaatgccattcgtaaatgtcccgggcttgtgatgaggccgccggaccataaactgtacaggcgatacagcaataggctgatggagttcttaagaacctatactgactacatcgagcaggtaagcgtagatgagtgctatatggactttacggagatcgcgccccgctttgcctctccggtggacggcgctctggagattaagaacgaggtatgccggaaattcggctttaccgtcaatatcggcatatcgaccaacaagctgctggccaagatggcctcagattttgagaagcctaataaagtgcatacgctgttcccggaggagattcaggcgaagatgtggccgcttcctgtgtgggaactgtatatggcagggcgttccagcgtggagacgctagagaagctggacatacgcaccatcggcgatctggcctgcacggatccaaagatactggaactgcatctgaagagccatggcaggaaactctgggaatttgccaacgggatcgatcactcggaggtggcaagagaaaaggcagaggcaaaaggaattggcaactccaccacgcttccacgggacgcaaggacgcaggaagaggcggaggcagtgcttgaggatctggccggaagcgtcggaagaaggcttcgaaaggcaggacagaaagcggggatgctaagcgtggagataaagtaccacacctttgaatctgtatcccatcaaagacagctggaaaagccgacgaatcaggaccaggagatttaccaggaggcgagggacctctttctggagttatggaatcaggagcccataaggcttcttggaatcagaagttcgaaactaacagaggagggagagccggagcagcttagcatatttgatattcgctttgaggcagatccgaaaaaagaaaagaaggaaaagatcaacactgccctggaacagatccgcaaaaagtatggcaaggatattgtcacaaagggtccccattcttgacagaaaaatatttcaacgatatactgataattagaagagcagctgcgaattataagtttatagtttgcagttgttcttttttggctgataaggaggtatttgatatgggaaagataaattggaaggaatgggggatggacattcttgtggatctattcgcgggaatgatcatcgccataggaatctataactttgcgctgaatgctaatttcccggtagcggggttctcgggaattgccatcatcatgtatcatttgatcgggctgccggtgggagccgggacgattcttttaaatgttccggtggcaattttctgctataagttcctgggaaggacattttttatcaaatctgtaaagtctatggttatctcatccttcctgatggactatattgcgccgctgctgccggtatacgagggcagcaggcttttggcggcgctgtgcatgggcgtgctgtccggagcaggatatgcgctgatatttatgagaggctcatctactggcggccaggatttcatcagcgtggcgattaagaaggtaaagccgcatgttaccctgggcatgattacattcgtgctggatgtggcaaccatcgtgctgggaagcgtcctggtattcaaggatgtggacgggttcatctatggcgtgatcgttacttatctcatggcgatcgtcatggaccggatcctttatggcatcgacgaaggcaagatgacatttattgtgacggagcatggcgaggaggtttcaaagcatattgacgcctattccggcagaggctccacgattctaagaggaatgggaggctattcaaagcaggagaaggatgtggtgatgtgcgcgtgcaacaacaagcagatgtacgcgatcaagaagatggtccataagatcgatccccaggcatttacgattattatggagtccaatgaagtcgtgggagagggcttcaaggaagaaagtggattagattgacaattctgctgccctaggagtagaattaaagataatcaggttggtttcgcaaaagatacatgaagtaatcggaaatggaggcgtatcgtgagtgtacaggagttctacgagtctataggagtaaactatacggatgtattaagaaggcttggcagtgaaaaatttattgagaaatatttaaagaagatgctggatgacggcaactacgatatattaaggcaggcagtcgagaaaggagactttcccgaagcattccgggcatcccataccctcaaaggaatctgcctgaatctggggctttccacgcttagcgaatccagcagcatgcttacagaggaactgagggatgatcctgacgggaagaaggtcagagagttgtttgccaaggtggaagacgattataagaatattacggaaggaataagaaatattctactatgatgaagatgcagaagatattggtggtcgacgattcggagatgaaccgctcgatccttgccgatatgctggaagatgagtatgagattatagaggccaggaacggaatcgaggcaataacggcaatcaagaagcaggaagatgagatatgtcttgtgcttcttgatatcataatgccggagatggatggcttcgaagtactgaccgttatgaacaggggcggctggatagaaaacatccccgtgatcatgatatctgcggaagtatcgtccacctatgtggaccacgcgtatgatctgggggcagtggattatatcaaccgtccatttgatggcaaggtcgtacggcgcagggtcaagaatacgatcatgctgtacgccaagcagaagatgctgcaaggcatgatcatggagcaggtctttgaaaaggaaaagaacagcaatctcatgatcgagatactaagcaacattgtcgaattccgtaatggggagagcggcctgcatgtactgcatatccgcacgataacggagacgcttcttaagcagctggcaaggaagacaagccagtatggcctgacgcattccagaatcatgatgatcagcaacgcctcggcgctgcatgacattggaaaggtatccatcgatgagaagatactgaacaagcctggcaaactgacggatgaggaatttgagattatcaagacccatgccgagattggcgccgagatgatgaagaatgttcccttccggcagaatgaggaactggtaaagatcgggtatgatatctgccgctggcatcatgagcggtatgacggcaagggatatccggacggcctgaagggggaagagataccgatcgcggcccaggtagtggccttggcggacgtatatgacgcgctgatcagcgagcgggtctacaagccgccttttaccccggatcaggcgctgtccatgatcctgaatggagagtgcgggacatttaatccggtacttctggagtgcttaagagaggcaaaggattacatagagaaagaattggaaatcaattccctaaaagaaatgacgcagaatgagatgcaggatatcacggcggaattgatcgcaaaaggagatatgaccgcgtcagaccgcactttgcgccttctggagcaggaaagaatcaagtaccagttctttgcttccatgtctcaggagattcagtttgaatacaatgccttggcggacatgcttattttttcagaatgggggtccaactatcttgggatcggcgagttaattatgaagccgtttgagaatgcgcagatactggaacttgtcaacaaggatgatctggacgatatccgccacaaggtcaaaaagaccaccttcctgaacccgattgtcagttccaattatctgctgaccatcaataaggagaagcgctggtgcaagctggtggtccgggcactatggtcaggcgaggaaagcacagagatgacgggagccataggcaagttcacggacatccatgaggagcatgagaagattgacagcctggagaagatggcggcccaggatttgctgacgaatctgtataaccatgtgaatgccagaaagcagattgaacaaaggatccaggcaggagatggcaagaagtttggcatgatactgtttgatatcgactattttaagaatgccaacgatcaatatggccatctgtttggagactgcgtattaaaatacattgcaggcaagctgatgaagaacatacgtaaggaagatatcgcggcaagagtcggcggggatgaattcatggtattcacggaatatacggacaactttgagccgcaggcgagccggatattccgtacgcttaccgattactacgagaacttccgcatctccgtgagcatgggtgtggctacctatccggaaaacggaaaagattatgagcagttattccattgtgcggatcaggcgctgtatgcgtccaaacggggcggacgaaatcagtttaaattttacgacgattcgatgagagggatgctgtcggtattgtcgccgatcgattaaggggctgggaatccagcctcttttttaggcagtaattgcaattgccagagcacaatttaatctttgctgtgtgttgaaataatggtataataatgccatatggaaaatggacacaggaagtataaatttttaggaggcttatttttatgaaactgacacagttattggagcgtttggaatatgagatccgtcagggcagcgatgaggttgaagtgacagaattgatcaatgattcccgcaaggttacagaagggagcgtcttcgtatgcatcagcggagccgtatcagacggacataaatatattgacgatgtagcagctaagggggccgtggcagtgatcgtggaacgcccggtagaagcgccaaaagggcttacggtgattcacgtggatgatacccgttacgtactggcgcttatgtccgccgcctacttcggatatcccgcagagaagttaaaggtcatcgggattaccgggacgaagggcaagactacgaccacatacatggtcaagtctatcctggagggagtgggccacaaagtaggcctgatcggcaccattgaggcaattatcggggataaggccatcccggcgaacaatacgacgccggagtcttatacgatccatcagtattttgcgcagatggtggaagccggatgcgacagcgtggttatggaagtttcctcccagggcctgatgcttcacaggacagccggcatccagtttgagattggaatctttacgaacctgggggaggatcatatcggcccgaacgagcataaggacttcgaagattacaaacgctgcaaagggatcctgtttacacagtgcaatctgggaattgccaatgtggatgacagatggtatgaagacgtatttaagaatgccacgtgcaaagtggagacttttgggttctcggagaaggcagaccttcgcgctacagacgtgcagcatatttcaaggcctggatatctgggagtcaagtatcaggtaagcggcctgatggactttgatgtggagattgatattccgggcgatttcagcgtctacaattccttaaccgctatcgcggtgtgcaggcattttgatgtgcctgtggagaatattaagacagcgcttaaagtggcaaaggtaaaagggcgcatcgagatggtaaaggtgtcggatgactttacgctgatgatcgactatgcccacaatgccatgagtctggaaagcctgctgctgaccttgagggattaccatccgcagcgcattgttacggtattcggctgcggcggcaaccgctcgaagacccgcaggtatgagatgggagaagtggcaggacggctttccgactttacggttatcacatcagataatccgaggtttgaagaacctcaggccatcattgacgatattattgtagggatgaagaagacggatggaaaatatatctccatctgtgacaggaaagaggccatcaagtatgtcatcgagaacggacagccgggcgacgtcatcattctggccggaaaaggccatgagacctatcaggagatcaagggcgtcaagcatgatatggatgagcgcgtcctgatccgggaaatattagaggagttagatgtacgctgatatcattattgacataacacatgaaaaactggataaagtattccaatacagcatcccctcccatcttgaggggatgcttaaggttggcacagaagtcgtggtgccttttggaagaggcaataaagagacgaagggttacgtgaccggattctccagggaagccgggtatgatgtatcaaagatcaagccggttgccggaattgccaaggacagcgtggcgatcgagtctaaactggtggctttggctgcctggatgaaggagtattatggggggaccatgatacaggcgcttaagacggtgattcccatcaagcgtacggagcgtgtcaaagaaaagaggaggatccgcctgctgcttgatgaagaggctgggaaaaagatgctggatgtctgccttcataagaaccagaaggccagagccaggcttttggcggcattattggatgagccggagcaggagtacgaacttttgaccaggaagctgaatatcaccagggcagtggtaagagcgctggaggagcagaagatcgtggcgcttgaatcggaacaggtattccgcaatcctgtaaagcatagagtgcgggaaagggaagaagtcaggcttacggatgagcagcggcatgccatcggcgtattctgggatgactatagacagggaaagcgggaaaactatcttgtatacggggttaccggaagcgggaagacggaagtctatatggagatgattgacagagtgctgaaggaaggcgggcaggccatcgtcctgatcccggagattgcccttacgtatcagacggtcatgcggttctatgggaagtttggcgaccgggtgtccatcttgaattccagaatgtcccagggagagcggtttgaccagatggaacgggtgaaggcaggagaggttgacgtaatgattggcccgcgctctgccttatttacgccatttcccaatctgggactgatcgtcattgatgaagagcatgagacgacctataaaagcgagcaggttcccagatatcatgccagggagactgccatgatgcggggaaagatggaaggcgcaagcgtggtgctgggctcggccactccgtcgctggaagccttctatggctgcaagaggggacgcatcaagatgctggaacttaaaaacagggctacactccaggaattgcctgaggtatatgtagaagacatgtgcaaggagatgaaggcaggcaatcgttcgattttaagcgaccatctgaaagaactgatggaggagcggcttgagaaaaaggagcagatcatgctttttttgaaccgaagaggatatgcgggctttgtttcttgcagagcctgcggatatgtagtaaaatgtcctcattgcgacgtatccttatcggcgcataagaatgggaagatggtctgccattactgcggatatgaagaaccccaagtcaatctgtgtccttcctgcggctcaccatatatcgggggcttcaaggccggcacccagcagattgaagaactggtgaagcggcaatttccaagtgccagggtccttcggatggacatggataccacaaaggccaaggatggccatgaaaagatcctggagactttcgctaatgaagaggctgatattctgattggtacccagatgatcgtcaagggccatgactttcccaatgttactttggttggaatcctggcagcggatatgtctttgtattccaatgattaccgggcaggcgagcggacattccagcttctgacccaggcggccggaagggccggaagaggaagcagcaaaggggaagtcataatccagacctacagcccgcagcactacagcatccagatggcagcagcccaggattacgaaggattctataaagaagagatggattaccgggaattaatggggtatccgccggtggaacagctgcttgcggtgctgatgacagggccggatgaaggcatgcttgagacggctgccagatatttaaaggaattcgcgcagcttgcggataaggataaggaacttcagataatcggcccggccagcccctatgtggcaaaggtgagcgatgtctaccggagagtgctctacttaaaaggcgggaactataaaaggctggtagaggcgaagaaccggatggagcagtatatagaaattaataaaggatttcagtcgctgagaattcagttcgactttaatcccatgaatgtattttagaggagagaagcgtatggcaacgagaaagatcagagaaatcggagacgaggttttgacaaaaccatgcaaggaagtaacgaagataacattaaggactaaagtactcatcaatgacatgctggatactatgtatgaggcgcttggcgtaggattggcagcgccgcaggtgggcgtgcttaaaagaatcgtggtaatcgatgtgggggaaggccctattgtgctcattaatccagagattatagagacctccggcgagcagtccggggaagaagggtgcctgagcgtgcctggcaagtcaggcctggtgacgcgcccggattatgtgaaggtgcgggcactgaatgaagacatggaagagattgaattagagggcgaaggacttcttgcgagagcattctgtcatgagatcgaccatctggatggaaagatgtatgtcgatctggtagaaggagaattgcacgacgtgaattatgaggaggaagcatagatgaaggtcatattcatgggtacgccggagttttctgtcgggacgttaaaagccctgatagaggccggacatgaggtggtgctggcagtcacgcagccggataagccaaaaggaagaggcggcaggatgcagtatccgccggtgaaggagatggcgctggagtatgggattccagtattccagcctaaaaagatccgtgcgccggagtgcgtagaagaacttcggaaatatgaggcggatatcatggtagtcattgcctttggacagattcttccgaaagagattcttgagatgacgccttatggctgcgtcaacgttcatgcgtccctcctgcccaagtacagaggggccgcgccgatccaatgggcagtcatcaatggggagaaggtctccggggtgactacgatgcagatggatgaaggactggataccggagatatgcttttaaaagaagaagtgatgctggacgaaaaagagaccggaggaagcctgcatgataagctggctgaggcaggcgccaaactctgcgtgcgcaccttaaaagcgctggaagatggaagcgtcgtgagagagaagcagggagaaagccccacagaatatgccagaatgctaactaaggaactgggctgcatcgactggactaaagacgccgcctccatcgaacgactggtcagaggcttgaatccatggcccagcgcttatacggactggaatggaaaagtcatgaagatctgggaggcaaaagacatggaaggcgagacaggcaaggctcccggaaccatcgtcaagatagaaaaagacggattcctggtgcaggcaggagcgggactactgaaaatcctggaactgcagatcccagacaagaagcggatgaaggcagacgcgtttctgagaggctatcaggtggaagaagggacgatgctggcctccaatatctgaggaaatcattaataattgttaaatttgtatgaaaagacgtttttttgtcgggttttcatatataataacaaatatatttttaaaagcaggaggcgtataaagtatgtattatcctatgttttttgaaccaacatatatgctggtcattataggcgtgatcatctgtctgttggcttcttccaggatgaagtcgacatttaataaatactcccgtgtcaggaaccattccggcatgacgggaagagaagcagcagaacaggtcttaagaggggccggcatctatgatgtaagagtcgagcatatttccggagatctgacagaccactatgatccgaggaccaaggtgctgcggctgtcggatgctacctataattctacatccgtggcagcggtgggagttgcggcacatgagtgcgggcatgcgatccagcacgccacagggtacgcgccgcttaagatccgcggggcgctggtgccagtggcgaactttggaagcacgatagcatggccgttgatcctgatcggcctgctttttagcagccagtcatccatgctgtttttgaatctgggaatcatagccttttctttggcagtattattccagatcgtcaccctgccggtggagttcaatgcgtccagcagggccatacgcatattgggcagcagcggcatgttatatgaggatgaagtagatgctacgaaaaaggtgctctctgcggcggctctgacgtatgtggcaggcgcagcctctgcaatcctgcagcttctgcgtatcatactgctggccaacagcagaagggattagatggaggaagaagaatggcagcatctgtaaacgggcgcgaactcgtgcttgatatactgcttcagatcacaagagacggggaatatagtcatattgcccttaagaatgttcttgataaatatcagtatcttgataagaaagagcgtgcatttatcacgagagtggtaaatggcacgcttgaacatatgatagaaatcgactatatcattaatcaattttccaaagttaaggttcagaaaatgaagcctgtcatcaggacgatcatacgcagcgcggtataccagttaaaatatatggatagcgtgccggattccgctgtcttaaacgaggcagtaaaacttgcttcaaaacgtggattttcaacgttgaaaggatttgtaaacggggtgttaaggagcataagccgcaatctggcaaatgtcgcgtatccccccgaggaagaccggcttgcgtggatggaggtccgctacagcctgccccagtggatcctaaagcagtggcttgcatcgtatgatgaagagacggtgaagaggatggcagaagatttcctgaaagagaagcccataacggtaaggtgcaatctggaaaagattacgaaagaagaactgctcagactgctgaaagaagaaggcgttacggtggaagaggagccagatgtcccttatgcgctatacttatcaggatatgaccatctggcaggattaaatagcttccgacagggatactaccaagtacaggatatcagttcgatgcaggtagcccagtgggcagcgcctgagacggacgattatattattgacgtgtgcgcggcgccggggggaaaggccatccatctggcggagatgctggcggaaaccggtcatgtggaagccagggatctgacggagtataaggtagggctgatccgggagaatatcttaaggagcggccttcataatatagaagcagtccgtaaggatgccacggttcaagatgaatcatccattagaaaagcagatatcgtcatagccgatctgccatgttctggcctgggcgtgctggggaaaaagccggatctgaagagccggatgacagaagagatgcagaaggaattggcattgctgcagcgcagcatgctaagagtcgttaaggagtatgtaaagcctggcggaaaacttctatacagcacttgcacgatcagcagagacgagaatgaagagaatgcaagatggttaacggaaatagatccgaagttccgcctgatccgccagaagcagatgcttccgggaagggatccgggggatggattctatatcgccatgttccagagggagaatcatgagtaagaaagatatatgctcttatagttttgaagaattgaaagaagagatcgcacggattggagagaaggctttccgcagcactcagatctatgaatggctgcatgtaaaactcgcagagaactttgatgagatgaccaacctctcaaaggcgcttcgggaaaagttgaaggaagagtatgagatcgcgaaagtcaagatgattgaccatcaggtttccaaggtagatcctacagaaaagttcctgttcgaattgtgcgacggcaatatgatcgagagcgtgctgatgaagtataactatggcaattccgtatgcatctcgtctcaggccggatgccgcatgggatgccggttctgcgcctccaccatcggagggctggaaagaagcctggcgccttccgagatgctcaggcagatctatcagattcagaagatgacgggagagcgggtatccaacgtagttgtcatgggcactggggagccgctggataattatgataacttcgtgaaattcatccatatgctgagcgatgagcatggactacatatcagccagcgcaacatcacagcctccacctgcggcattgttccgaatatgaagaggcttgcggatgaaggccttcagattacgcttgccctctccttgcatggatcgacgcaggagaagcgtaagaagctgatgccggtggcaaaccgatacgagcttccggaagtcctggatgcctgcgattactattttgaaaagacggggaggcggatcacctttgaatatagtctggtagaaggcgtgaacgatcagatggaggatgccagagaactgatctttatattgaagaagcggaattgtcatctgaatctgattccggtgaatccgatcaaggagcgggacttcaagaagccggacaggaaaaatgcccttgaattcaaaaataaacttgaaaaaaacggaattaatgttactataagaagggaaagaggctcggatatcgacggagcctgcggccagctgcgcagacgccatacggccgcgaatgaaggagaaccagatgaagatatatgcaatgactgatgttgggagaaaacgcgagataaaccaggactacgtatatgtgacggataagcccatcgggccattcccgaatctccttgcggttgccgatggaatgggcggccacaaggctggagacttcgcgtccaaatatacggtgaaggtattgcgggaagaattagaggatacgcctttggataagccggaggagatcttgcgcaacgtcgttggcattgcaaatcataagctgattgaggcagcatccacagacattaagctggaagggatgggcacgacactggtagtagccactgtggtaggcaatacgctttattttgccaatgtgggagacagcaggctctatctgatcaacgataagatccggcagatctccaaggatcattccctggtagaggaaatggtaaggcttggaggcatcaaggccgaagaggccaagaatcacccggataagaatattataacgcgtgccattggagtcaaggaagatgtggaggcagacatctatgaataccgcttgaaaaagggggatgtcattttgatgtgtaccgatgggctcagcaacatggtggaagatgaagatatgttcgatatcgtcaagggttcccgggatgtggtagaggcagtacagatgttgatcgagaaggcaaatagcaatggcgggagagataacataggggttgttatagcggagccacttgcggatgaggtgagtatatggtaaaagatggtatttttcttggtaaaaggtatgaagtgttaagtaagattggagcaggggggatggccgatgtctataaaggcaaagaccatatgctcaatcgttacgtggcaatcaaggtcctgaaaaaggaatttaaggaagacgagaattttgtgcgcaagtttcgttccgaggcccaggcggcagccgggctgatacaccctaatgtggtaaatgtgtatgacgttggggaagaccgcgggctttactacatggttatggaactcgtggaaggaattacgctcaaggaatatatagataagaagggaaggctttcccataaggaaactataagcatcgcgatccagatgtgtacggggatcggcgtagcccacgcggccaatatcatccacagagatatcaagccgcagaacatcatcatatcaaaagacggcaaggtaaaggtaacggactttggcattgccaaggcaacgacatccaatacgatcagttccaatgcaatgggctctgtgcattatacctctccggagcaggcaagaggcggattcagcgatcagaagagcgatatctactcaatcggcattaccctgtatgagatggtaacggggcaagtgccttttgacggcgactctaccgtttccgtagcaatcaagcatctgcaggaggagattacccctccgtcagagatcgtgccggatataccgtacagcctggagcagattatattgaaatgtacccagaagaacggggagagaagatacaagaatacggatgagctgattcaggacttaaaacgctcgctggtagacccggacggcgattttgtcataattccgcccctgggcaatgcggatacggttattattacggatgaagaattggatgatatccgcagttcttatgatgaagaagacgattttgacgagtatgacgaagatgaatacggcgacgaagaggaatttgacgagtacgacgaagatgacgacgagtacgatgagtatgatgacgatgaggagtacggcggaaaagggaagaagggcaagggttctgatgatgtaaacccgcgcatgaagaaggttatgaagatcctgaccatcgtagtggcgattattatcgtgttcatcctggtatttgccattggcaaggcagccggcatatttaaaggcgggtttggcattgatacggttgataccgacgagaaggcaaaggtgaaggtgccaaatgtagtgggaatgacggaagacgaggcgaagaagaccctgaacaaaaagggactgggctttaaagtcgttgccagagaagagtccaagaagtatgaggaaggcacggtatccaagcagaagacggaggcgggcaagcgggttgccaagaatacgaccatacaggtagtggtaagttccggccttataggagatgagatcacggtaccggatgtcagcaacatgagtgagagcgaggctcagaaggcgctggaggatgccggatttgagaagatcacatcggattttgcatacagcgattccgtagccgagggggatgtcattggcacaacgcctgcggcgaatgccaaggctaccaaggacacggagattgtcatgaaggtgagcaaaggctcagagaaaaagacggttccgaacgttgtaggccagcaggacggggatgcccagaatgctattaccgccgcaggattgacggtagggacggttacctatgagtattatgatgacgttccgaagggccaggtagtatcccagacggtggcaggcggcaagaaggttgccccaggtaccagcgtaggactgacgatcagcagcggtccgaagccgccggagaagattagcgtgccaccagtgacgaatacgacgctggataatgcaagacagcttttaagcagtgcaggccttaaggctggaaatataacctatcagcatagcgatacggtcgagtcaggcaatgtcatcagctgtaatccaggcgtgggaagcagcgtggatgaaggatcgtctgtaagcctggtcgtaagccagggaccggagcaatccggcggcggagagcaggaaggcacccagtaaccgaggccaaggaagcagacaggatagatatatgcaaggaaagatagtaaagggtattgccggattctactacgtacatgtagtagaatccggtgtttatgaatgtaaggccaagggcgcgttccgcaaggagaagattaagccattggtgggggataatgtaattattgaagtgctggatgaagcgcagaagacgggaaacatcacggaagtactgaaaagaaagaatgaactggtacgtcccgcggtcgccaacatcgaccaggcgctggtcgtatttgccatcgtaaggcccaacccgcattttaacctgctggaccgttttcttgtaatgatggaaagcaagaagatcccagtgattctctgttttaataaagaggatatcgcaaccgatccgcaggtgaaggaactagaagccatctatgagaactgcggctatccattgatttttaccagcgctctggaagataagaatattgaccaggtgaaggaagtgctaagaggaaagacgacggccatcgctggtccatccggggtgggcaagtcatccatcatcaatattctccagcccgaagccaatatggagacgggcgcaatcagcagcaagatcgagaggggaaagcataccaccagacatacggaattatttccagtggatgcggattcctatattatggatactcccggatttagctcgctgtatgttaatgattttgaaaaggaagaactgaaatactacttccccgagtttgcagcatatgaaggaacgtgcaagttcaatggatgcgatcatatccatgaaccgggctgcgcggtaaaggaagctgtggaggaaggaaagattcataaagtacgatatcagaattatatagagatgtatgaagaactaaagaataagaggaggtattgatgatggagtatatattagccccgtcaattctggctgcggatttcaagaatctgggccaggagatgaagaaaacagaagaaaatggtgccagatatctgcattttgacgtgatggatggcatgtttgttcccagcatatcctttggcatgccggtgctcgcatcgataaaggatgggacaagccagacgatggatgtacatctgatggtgcaggagcccatccgttatgtggaagcatttcagaaagccggcgcggacatccttacagtgcatttggaggcatgtgaggatgtgaaagcgaccattgataagattcgggaatgcggtatgaaggttggcctgtctatctgtccggagacggaagcggaggcactaaagccttatcttaaggaggttgacatgattctggtgatgagcgtccatccaggattcggaggacagaagtttatcccggaatctcttgagaagatccgcaaggttcgggaaatgatagaagaacaaggactttccgtagatgtggaagtcgatggaggaatctaccttacgaatgtccgggaagtgctggaagcgggagtcaatgttgttgttgcgggctcagcagtgtttaagggcgagccggaacagaataccaaagagtttatggagatattaagggattatgagtaagaggattgttattgtaagcggcgggcagctggatgaggaactgacgctttcaattcttaaggatgagaaaagccagtgtattattggagtagataagggcatggaatttctgtatgcccaccagatcatgcccagttatattgttggtgactttgacagcgtaaatgaagagattgccgattattacaggaatgagaccaatgtcccgatccgggaattcaatcctgtaaaagacgcgtccgacacggaaatcgcggtcaggctgtctcttacgctcgggtgcagcgaactgattattctgggcgccacaggcggaaggatcgaccacctttgggccaacgtgcagacccttaccattccatacaaggcaggggtggatgcaaagattatggacagccagaatatgatccgcctgatcgggggcggtgatacgcatatccgcaaggatgaagcatatgggccgtatttttccgtgttcccgctgggcgaagagatctttggatttaacatagagggcgcaaggtatccgcttagaaaccatacgcttacgccatatgatagcctgtgcgtcagcaaccagattgcagaagacgaagaagaagtcataatcagttttccgtccggcaccgtaatcttgatggagacccgtgacaagagagaacaaaagtgatacactactgtatgttctgaagaataatgaagcatgaagagaggatctatagatgaagttaggaatcgtggggttacccaatgttggaaaaagtacattatttaattcattgacgaaagcaggagcagaatccgccaattatccgttttgtaccattgaccctaatgtaggcgttgtaaccgtgccggatgagaggctgaatgtactgggcgagatgtatcacaccaagaagatcattcccgcggcaatcgagtttgtggatattgccggacttgtaaaaggcgcctccaagggagaaggccttggcaaccagttccttgcaaatattcgtgaagtcgacgcgatcgtccacgtggtacgctgcttcgaagatggcaatatcgtgcacgtagacggaagcatcaacccgctgagggatattgagaccatcaatctggaattaattttttcagatttggaaatacttgagcgtagaattgcaaagactaccaaggtggcaagaaatgacaagacggctgcaaaggaactggctttgcttgaaaagatcaaggcacatctggaagaaggaaggcttgcaaagactttcgagggcgctgaggatgaggaagaactggcctggcttacggggtataatcttctgacctataagccggtgatctatgcggcgaatgtagcagaggatgatctggccgacgacggtgccggaaacgccggagtacaggctgtaagagagtacgcagggaaagagcagagcgaggtgttcgtagtctgtgcgcagatcgagcaggagattgccgaactggatgatgaggagaagaagatgtttctggaagatctgggattggaagaatccgggcttgagaaactgattaaggcaagctaccggcttctgggactgatcagttatttgactgccggagagccggaggtacgggcatggaccattaccaagggcacgaaggctccccaggcggcaggaaagattcatacagactttgaacggggatttattcgggcagaggtagttgcctacgatgacctgattgaatgcggaagccataatgcagcaaaggaaaagggattaatcaggctggaaggcaaagactacgtcgtacaggacggagatatcatgctgttccgcttcaacgtataggaaggaagaccgaagatgcacagaactattgattttccgaatatagggatacatcttacgtcagtaggcgatcatattactatatttggctttgacatcgcgttttatggaatgattataggactaggaatactgacggggcttttgattgccgcggcagaggcaaaaagaagcgggcagaatccggaggattattttgatctggcaatctatgcggtgatattttccattatcggggcaaggctttactatgtggccttctcctgggatatgtacaaggatgatctgctgagcatcctgaatatccgtcaggggggacttgcaatctatggaggcgtgatcgcggcggtaatcacggtatttgtatttgcgagggtcaagaagatgtcggcgacgctgatactggataccgcaggcctgggacttgtagccgggcagatgattggacgatggggcaacttttttaaccgggaagcatttggcgagtataccaacagttttctggctatgcggctcccggtagatgcagtcagaggctcagatattactgaactgatgcgcaagaacatggagacggtaaaaggcgtatcctatatccaggtacatcctacctttctctatgagtcgttatggtgcctgatggttttgattatcatgctgatatacagaaagcataagaagtttaacggcgagttattccttgtctatctgtttggatatggcttgggacgattctggatcgagggactcaggacagaccagctgctgattccgaagattgggcttccggtatcccagatactggcgggagtgctggtggtggtatcgctggcgcttattatctataaacgaattgaattgaaaaaagtagagaaggaataaaagggtatcatagatatcccctgcaaagaatgcgaaggcaatgtgccttaggactctttgcaggggatatttgcatatagggagatactatcgtttcaatattgccagaatgataaagagggcgcctcctataaaggacagatcctttgggcatcgattgctgatcttacgcccgaggaacaggccgagataggtgaaggcctctcccatggcgaatgtggcagccaccgtcagaggaatggagatcttgaggaatgcggccattgtgcctgctatgagactgtcaatagacatggcaagggaaaagaagatggcctccttccaggacaggcagtgactctggtcggcatctgcctccataggatcgctgtaaatattaatgatgaaacgtaactgtgaaaacgtaaaatgtatatcttttcggacttccttatggtgcctgagatactgccggatgctggagtccgtcagtttcaggcacccaaggaagaggaggctgaaaaaacagatctcacgggtgaatgtctccgggatgatccggtcaaggagattgccgaacagcagggatatgcccaggcataggctgcatatcccattgaccgcaaggatctgcttccaggaaagccgaacctggttggtgccatatgcggcgctggcaacaaaagtgtccaggcaaagggcagaaacgagaaggaaaatatgaagaaacataataacatgcctttttccctattatattcagaaaaagtcgttccgacataacctgggatatattttgcggaagaaaatcatatatttgcagagaagattcttgttcataagacagaaagtgggcaaaatatgacggtagggtactatattctgattttcttgtttgggctggtgctcctggtatgggggagcagcctgtttgtagacagcgctgtgtctgtggccgggaggctgcatcttcctgaggtactgatcggggctacgattgtaagcctggggacgacgcttccggaggtgctgttttcaaccatggcatccgtgcggcatcttccggaaatggcaattggcaatgcgctgggctccattctgtgcaataccggattcattgcaggaatgatgctggttttgcgtccgatttatctgagcggcaaggcagtggcaaacgtcgtatccgggacggtgttcctgggcttgtcatttgcggtatatgtggcgggcggcgtcatggggcagggactatccaggacgacgggcggcatgcttctcgtcatctgtattctgtttcttgcttataatgtacgcaatgcttacagccagcagcaggaggagaaggagatgcatgcccaggaacaggcctttggaatcagcgacattatccggcttgtgctggaagcggtagtgatctatatcggtgccagcatgctggtggaagtagggccgaagcttgccagggcctttggcgtcccggaaatgatcatttctcttacattcgtggccttaggaacctctcttccggaactggtcacctcccttatggcccttagaaagaagcatgcatccctgtctatgggaaacatcataggagcggatattctgaattttgtgatggtagggggactgtcggctgtcatctgcccgatcccgttccaagagagtatcttgaaattagaactcccggttatctttttcatgctgtttattctgtgtgttccatctattagcaggaagaaggctggcaggctgcaggggcttcttctactgggaagctatatcctgtatctgacagttctggcggcataaggtggttttttcttggaaagaagtaaccatgatttgtgcaatattactaaaaagagaaggtaaaaatatagctacgcaactaaggaagttggaaaaggatgaaagaactttcagaaggattcaagttgcttgaaaataaaaacaatgctgttatactaaagtcagaaaagacaaggaaggtgcacaaagatgaatgagagagtgagcaatttacaggggaaattaatcgtatcctgccaggcgctgccgcacgaacccctacattcttcttttatcatgggaagaatggctgttgcggccaaagaaggcggagcggcaggcatccgtgccaatacaaaggaagatattaaggagatacagtcacaggtcgatcttccggtcataggcatcgtaaagcgtgattacgaaggaagcaaagtgtatatcacgccaaccatgaaggagattgatgagttgatggaagtagggccggagatcatcgcagtggatgcgacatctgaccttcgcccgggtaatataacgatcgatcagttcttcggacagatcaaagagaaatatcctgaccagcttcttatggctgactgctctaccatcgaagaagcaattcatgcagatgagcttgggtttgactttattgggacgacgatggtagggtatacggatcaaagcaagggtgatcggatagaagaaaacgattttgaaatcttgcgcaagattgtagccaatgtaaagaataaggtcattgcagaaggcaatattaatacgccgcagaaggccagacgcgtgatcgagctgggggcattcagcgttgtcgtaggctccattatcacgaggccgcagctgatcaccaagtcatttgccgaggaactagacaaataagaacattataacatcacataaaaataaaaaatgaaaaggagaaaagcattatgagaaacttggacaagtacaaaggcgtcattcctgcattctatgcatgctatgacaaagaaggcaacattagccccaaaggcgtgcaggcacttactagatattttgtggaaaaaggggtaaaaggaatctatgtaaacggatcttccggagagtgcatctaccagagcgtggaagataagaagattgttcttgagaatgtgatgaaggcggcagaaggaaaactgacggtgatcgcccatgttgcatgcaataacacgaaggatagccaggaactggcgcgccatgcggaaagccttggagtcgacgcgattgcggcaatccctccgatctacttccatctgccggaatatgccattgcgcagtactggaatgatattagttctgctgcgccaaatacagattttgtaatctataatattccgcagcttgcaggcgtcgcgcttaccatgggcctgtttgaggaaatgagaaagaacccaagagtaatcggtgttaagaattcttctatgccagtgcaggatatccagatgttcaagcaggctgcgggagaagactatattatcttcaacggtccggacgagcagtttatgagcggccgcgtgatcggagcagaaggagccatcggaggcacttacggggcgatgccagaactgttccttaagctggacgagcatgtgaagaatggagagatcgaaaaggcaagagaacttcagcacgcgatcaatgcgatcatctacaagatgtgttctgcccatggaaatatgtatggagtgattaaggaaattcttaagaggaatgagaatctggaacttggcggagtcagggagccgctgccttcattgatagacagcgacatgccgatcgtagaagaggcggccagaatgatctgcgaagcaaaagaaaagtatttggcatagtataagccagcccagacacgaatgagagagttttaggaggaaaagacatgcaaggctttacagtaattgatttggttattttgatcgtatatctggcggcagtcctgttcgccggccttcacttcgcgaagaaggagatgaaggggaaggagtatttcaagagtgacggtaccgtgccctggtgggtaacgtccgtatctatctttgcaaccctgcttagtccgatatctttcctgtcgcttgcgggaaactcctatgcaggaacatggatcatgtggttcgcccagctgggcatgctgctggcaatcccgcttaccatcaagttcttcctgccaatctacagcaagctggatattgatacggcgtatcactatctggaattaagattcggaagcaaaggactacgcgtattaggcgccgtaatgttcatcatctaccaggtagggcgtatgtctatcatcatgtacctgccgtgcatggtattgggaagcctgactggcatcagcgtgaatctgctgattatcattatgggagtcatcgcgatcatttattcttacacaggaggattaaagtccgtactatggacagacttcatacaaggatccgtattgctgatcggcgttaccttcgcgctggtattccttctttcacatattgacggagggcttggagccatcttcacggcatttactgcggaacacaaattcctggcagtcgaccagccgatctttgacatcaatatattaaaagacagcgttttcattatgatcgtgggcgcaggctttaatacgatgggctcttatgtatccagccaggacatcgtacagcgttttacgacaacgacagatacgaagaaactgaataagatgatgctgacaaacggagcattatccatctttattgccaccgtattctacctgatcggtacaggactgtatgtattctaccagcagaacgcactgccgccggcagcagcgcaggatcagatatttgcatcctacatcgcgttcgagcttccggtaggcatcacgggacttttgctggcggccatctacgcggcatcccagtctacgctgtcaacagggcttaattctgtggcggccagctggaccttggatattcaggcaaggcttagcaagaaagagttaagtttcgagaagcagaccaagattggccagtatgtttccctgatcgtcggaatcttctctatcgcggtagccatggttctggcaaatggcggggttaagtccgcatacgaatggttcaacggatttatgggactggtacttggaatcctggttggaacatttatcctgggagcatttacgaaggtagcaaacacctttggagcaacgcttgcatttatcgccgcatcagcggtcatggttggaatcaagtacttcgctccggcaggctccgtatccatctggtcctactctttgatctccatcgcggtatccttagtcgtaggcattccggcgagcctgatctggagaaaggtaaagaacgatacatccgtaccggctccgaacactacggttttcaaaaaataagccaagggagaatagaaaatgatatttggaaatgttgggaatttaaaagaattcccgtatctggaagaacaggtacaagagtgctttgcgtattttaaaagccataatatggcagactatgaaaagggatgtcatgagattgacggagaccggctgttcgtaaacgttgtggaatatacgactacgacgacggaggagagattctgggaagcccataagaattatctggatgtccatgtgatgatccggggcacagagcagatcgatgtgaacttcatacagaatatggagcagaaagattttgtggaaaaggatgattttcttccgctggaaggagaaaagaacggccatgtaatattaagagatggcgatttcctggtctgctatccaagcgacgggcaccggactgcaattgcggttaatggaccggaagagataaagaaggcgatttttaaagtaaagatataatctgcggcgaggcaaaccagagagactctctggatttgcctttttgcagtatagacgaggtgagaagatatggatttggtacttttgattgggcagagtaatgcgaaaggttgtgggaacccggaagtaagcgagattccctgcgggcatgcatgggaatacttggaaaactttaccggacaggctatgattcctatggggaggacgctgcagctgtctgagggaagaggaaccatcgccccggcatttgccaaccgctactatgacattatgggcgaagatatatgcatcattcattacgcggtggatggcagcaggattaagaattgggtccatgacaagaatcatttccttgatgcagccatggaaaagttccggcatgcagaagcatatgtgggaatgagggcgccgatcggacggagattcgccatatggatacagggagaaagcgatggaaagtatgggacagaccccatctattatttagagcgcctgaaagaaatcggatggatactgaaaaaggaatgcaagatagaagagacctttgtaagccggacaggaagatggcttccggatgaagagaatctggcccgttgccgccgcatcggggcagcccaggaactggcatgcatggaacacgacaatctgattcttgtgagcaagatggcatctgcattttatgaacaaggactgctgcaggacgaggtacattactgcatggaggcgctgaatatgcttggcagcgagattgcagaaaatataggaatatactataatgagaaaagaaggcccgtgctttctgagacagaggatatggagcgggcaagagaggttctgaatatacttaaaaaagcagaggtatcgttatgaagaaatatgtaagtatcgacattgggggaacagagatcaagtatggactcatcgatgaaaaggggcagattctgacccggtctaagatgaagacagaggcctacaaaggaggcccctccatactggaaaaagcggtaagaatcgtggaggcctaccaggcgttggaagaaatcagcggaatatgtatttcaaccgcaggtatggtagatactgaaaaaggagagattttctatgctgcgccgctgattccccaatatgcggggacaggattcaaggatacgatgatccagaagttcagcctgccatgcgaggttgaaaatgatgtgaactgcgcagggcttgcagaatatatgtcaggcgcgtcaaaaggcacgaaagcctcgcttatgctgaccgtgggtacaggaatcggcggatgcatcatcatagacgggaaagtctaccatggctgcagcagcagcgcctgcgagatcgggtacatgctcatggacggcagtgattttcagacgcttggcgcagcaagcatcctgtcaaagaaggtggcagcatggaagaatgagcccgaagaacagtgggatggataccggatattcgaagcggcaaaagcaggcgatgagttatgctgtcgggcgattgacgagatggtggacgtgctgggcaaagggattgcgaatatctgctatgtgctgaacccggaagtggtggtgctgggtggtggaatcatggcccaggaagagtatctggcaaagaagattcgcggcgcagtggacaagtatctggtggcaagcattgcgtcccgcacaagaatcgcgttcgcgcagcataggaatgacgcgggcatgctgggagcgttctatcatttcagaagccttcatgccaggtaaaggggagaacgaatggaatactatgtaaaatccgtagtaccgattatagaatctaattatgacaattttacgactgtggaaaagaatattgccgactacttcatccaaaaccacaagaagatggacttttcggcaaaggctgtggcagaaagactgttcgtgtctgaggcatccttatccagatttgccaagaaatgcggataccgaggctaccgggagttcgtatatcagtatgaggagacctttgtagagaagcaggagacgatcaccggcaataccaggatggtcctgaatgcttaccaggaactgctgaataagacatacagcctggtggatgaagcgcagattgcaagaatcacgaagtatctgaatgaggcagagagagtcttcgtatgcggaaagggaagttccggcctgacggcaagcgagatggagatccgcttcatgagaatcggcgtggatatcgattcgcttcaggacagcgacctgatccggatgcaggcggtattccaggataagaaaagcatggtgttcggcatcagtatcagcggcgagaaagaagaagtgctgtaccttttgagggaagcaaaaaaaagaggggcaaggacggtgctgatcacggcgaagaataaggatatcttcggtgaattctgcagcgaggtggtgctgttaccctcgcttaagcacttgaaccatggaaatctgatctcgccccagtttccgatcctggtgatgctggatattatctattcctattacgtggagcaggataagtatcagaaagaggtccttcatgacaatacattgcgggcactcgaggaaggcaggacaaagcaccgggatatgtttgaatagataataggaggaagaaatatgattataaaaaatgtaaaagtatttacagaagacaaggcttttatagatggacagatcgccatccaggacggcgtgtttgtaactggctggcaggagacggatgaagtgattgacggggaaggatgctatgcgatcccgggactgatcgacatccatttccacggatgcaaaggatatgatttctgcgatgggaccaaagaggccattgaagagattgccagatacgaggcttctatcggcgtaaccgccatttcgccggcaaccatgacgcttccggtggaagaactggaacgaatcttgtctgttgccgcatcttataacaaagagaacagagaaggcgcggatctggtaggcatcaatatggaaggtccgtttatcagcaaggtaaagaaaggcgcacaagatgagagacacattattcagtgcaatgaagagatctgccagagatttttggatgcctctgaaggcctggtcaaatttgttggaatcgcaccggaagataatgccgatgctgtcagatttatagaacagatgaaagacaaggtgcgtatttccctggcgcataccaatgcagattatgatacggcgatggcagcctttgatgcaggagcgagccacgcagtccatctgtataatgctatgccagcatttacgcatagggcgccgggagtcgtaggcgccgtgtcagacagcggccatgtgatggcagaactgatctgcgacggcgtgcatattcatccatcggtggttcgggcaacctttaagatgatgggagaagaccgaatgattctcatcagtgacagcatgcgggcgaccggaatgccggatgggcagtatacgctgggcggcctggatgtaaacgtggtaggcaaccgggcaactttggtatctgatggagccctggcaggctctgctaccaatctgctggactgcatgaggacggcagttaagaagatgggattgcctctggagacggcagtcgcatgtgccaccatgaacccagctagaagcctgggagagtatgacaagtatggctctattgcacctggtaagaaggggaatgtagtgctgcttgatcaggaactgaatctcaaagccgtaattaaggatggcaagagaatatcatagcagtttctggaaatccttctggatattttcatatttgtcaaggacaggttggcagaccaggcgggtggaagccataatctcatcataatcttttataaggatgtctacaatgttgctgtctatttttcccagatccttttgctcggatacaatagacagaacccgttccttggggtaggcatccttataactacgcgtaccggtgagggcgctgacgatatccgccacagccacgatgcgttcgcccaccgtcagctcgctggccgtcaggccaagcggatagccggagccgtccagtttttcatggtgccggagcgcgatgttctggatggtttcatctatctctcctccgaatatctccccggtgatatctacatgttttcgcatgacattcattgcctgggggctcagcctgcccgggtattccaggatttccaccggaacccctacttttccaacatcgtgaagcaatgcgccgcacacgatcttatccagatagtcggaatccagattcatccttcttcccaattcataactgatattcgtcgtggttatggtgtgggtgaccgtatgccggcttcgaaaatcgatgatgtagatcagcattttcaagtagtccgtaatctgctcctgggtaagcgggcttccccaggtagtaaagtcgaagttattgccttgagcatctatactctgtaaagcgtagtaaaatcctggctccagtaccagatccacaagccaggatgcaaaacgcctgtcccgtccctctctaagctttagggcgcaagcctcccaagtatttgatctcttggtcgtaaatacgtcgattctgtcagcaatatgtacgatctgcgcatatctcttcgtttcctcatctatttcatttattccagccagttcctcccacggcgtgtgatgatataacacgacaggggaaagtttttccagaggagagaagtactttaggaacagatagccatacatagaatgctcccacatattctgggtctcaaacagaagcattttggagatctcctctgtcttatatgccccgatatcatggagcacggttacaagacagaaatcccttagtttattaacgtcattttctccggtctttttcaaaatctgtgctgcgatatacgcaacccgcagtccgtgatccattagccgggggtctacgcagttgcaggttctccggataatctcaaacaagcttttgttgtcaatgggctctgtatactgaagcatagatagtgtcctccaagatttttataattcattctatcataattaagaagtataaaaaagagaatctgcaggaattcttattgatgtgtcctgatacaggagatataatgggaagcatagaagagaaaataacctgctctaaaggttaaaatagataaggagaagcgaaaagatgattgcaagaggagaaggggcctgcctggtatgcggcaagccaatcgtatattatgaaaaggcgcaggaaatggagtgcgtgatgtgccataagaggtttgaaagccatgccagctgtgaggatgggcattatatatgtgatgcctgccatgccaagaagggaatccaggtgattatggaaggatgcgccaagagcacatccagaaaccctgtagccattatgcaggaattgatgatgaatccctatatatacatgcatgggccggagcatcacgtgatggtgggagcagcccttcttacggcataccgtaacagcggggggaaaatcgatctggatgcggcccttcaggagatgaaggccaggggaagcgagtatcccggcggagcctgcggcctgtggggatgctgcggagcagcggtaagcacgggaatgttcatgagtattattacaaaggcaacgccgcttacaggacggtcatggaaactgtcaaatcttatgacttccagggcgcttaagtctatcgcacaacttggaggcccaagatgctgcaagagggattcctttaccgctgctatagccgcggtagaactggtaaaagaggaattgggagtggagatggaacttccggaaaagattacctgtgatttttcaaatgaaaacgagcagtgcctgaagaagcactgcccatatcatagaatatcatgttagcccattaggaagtcgaagatatcccatccttcggaattggcacgcttgtaaagttcagtgtagccgcagcgggtgcatgagatggtcacgaacttcttgttctggacatcgaataccttggcaaaattgcctcctgtagcttgaaactggtcgctttcatagtggttgtttccgcacttgggacatacatattgttgtttttccatcattgtttctcctttttattagtatacggttgagccaaaaggcatcagtgccagtttggccagtttaaactgctgcagaccaaaggggatgccgatgatcgtggcacaaagaatcgccccgatgacagccgattccacagccagccagaagccggagacgatcagccagattatgtttagcagaaacgagcctgcgcctccgccataggttacctctttcccaaaggggaagaagcttaaggcggcgaatttaaaacactgcatccccactggaatgccaacgatggtgatgcaccacagcaggcccgcaaatgcccagctaaggccgcttaagcatccgccgaagataaaccataaaatattccccagacatcccatatagaactcctcctttcttgtattctgtgataaaagacagctgctcttgccgtggcagaagcaacttatgattcagataataaaaaaagaccattatcatgacttccgccacgataaaagtcttgcacatctcatttgatacggatacctctcggtatcgggtgacgctttcaaatacacatgtaagtgttaggctactcccttttatctgcatgagaaaaatatactacgaacaaatcaaaatgtcaataggggaacaggaaagatgaagaaaatattgtttttaggagacagtattacggatgcccaccataatctgggcgtggatgacagaggactgggcgacggatatgtgcagatgattgcccggcggcttgaagaatccggcgaagaagcgagggtggaaaaccggggccatgacggttttactgtccagggattgtggagaatgcttggaagagactgcattctcaggaagccggatgtcgtcagcatactgattggctgcaatgacgtaggcattatgatgaatacaggaaaaagccttaatgagcaagggtttgcccgctattaccaaaatcttctggaagagatcctcacagagacagtggcggacataatctgcatgggtccattcatatttccccatccagaggaataccgtaggtggattcccgggattctcatggcagagcagatggtgaaggaagcagcgcttgcctacggactgccctttatccctctgcatgaagagatgcttaaagaagcggacagaaaagggtacgacgctttgacggaagatggcatccaccttacccgggagggcgcgaagatagtggcggggaaatggatggaatgctggaggaaacgaagtcatgacaatattaagatataatgcagaagcgtgcctggcatgttcttgaaaattgtgtcggatgcgtcttgacaaagaaggacaaataagttagtatttcagacaagcgagtatatattgtaaaaggctgtgaaaagaagaagtaataatcgttacacccatacagaaagctgccggcagatgagaggcgcatgaaggaagggattatgaatacatcttggagccgcgcaccaaaaagcgttcccttacagaaatagcaggggagggttaagtaggctgcgacgcaaggcatacgttacatgcataagctgcggcacgcgtaagttagggcacttataatttgttgcgcgcatgcttaatgaggctggcgatgcaaactgccggtgaacgaaggtggtaccacggatatatccgtccttatctagtaaatgactattagatagggacgtttttttgtatttgaaccaagaataataagaagatttcagagagaaaaggagagaagaaacatgggaatttatgaagaattgcaggccagaggcttaatcgcccaggtgacggatgaagatgagatcaaagaactggtgaacacgggaaaggcaactttctatatcgggttcgatcccaccgcggatagtctgcatgtaggacattttatggcgctgtgtctgatgaagcgtctgcaggaagcaggaaacaagccaatcgcattgatcggcggaggcaccggctacattggggatccatccggaagatcggatatgcgttccatgatgacgccggagaccatccagcacaactgcgactgctttaagaagcagatgagccggttcatcgacttttccgaagggaaagccctgatggtcaataatgccgactggcttctggacttaaactatattgaactgttaagagagatagggccgcatttttccgttaaccggatgctgacggcagagtgctataagcagagaatggaaaagggattgagcttccttgaattcaattacatgattatgcagagctacgacttctacatgctgttccagaaatatggatgtaatttgcagtttggcggcgacgaccagtggagcaacatgctgggcggaaccgagctgatccgccgcaaacttggaaagaatgcctgcgcgatgacaatcacgctgctgttgaattccgaaggaaagaagatgggcaagacccagagcggagccgtgtggctggatccgaacaagacctctccgtttgagttctaccagtactggaggaacgtggcagatgcagacgtcctgaaatgcatccgaatgctgacattccttccgttagaagagatagacaagatggattcctgggagggtgcccagttaaatacggcaaaggagatccttgccttcgaacttacgaagctggttcatggagaggaagaagcccagaagtcgcaggaagcggcaagagccttgtttagccaaggagcggcagcagacatgcctaccaccgaactgaacgaagaagacctgacggatggcaatattgacattctgtccatgctggtaaagagcggcctggttccgtcaaaatccgaagcgcgccgtgccgtacagcagggaggcgtagccgtggatggcgagaaagtggaagacatccatgccacgtttgcaggagaagatatggcaggggagggtattgtccttaagaaagggaagaagaacttccgtagaattgtgatgaagtaaatatttgccatgccgcgattgtataaagataccgcccgtgttctcttttagacatgggcggtatccgtttagaaatggatgaaataaaaaagaagagaaagacgctaaaaaacaaaataaaatacatagtatgcgatataaatactgccagtaaaatattgccagtgaaaaaatagaaacagatactaagataagaagcgtttgcaaaatagaaaaagtggatgcataatgaagatagaataaaaaatcagaataacaggaggagatcgctatggcatttcaggaaatatcacttgacagtctggaattcaacccgtttcataaaatttcaaaggaatggatgctcgtgactgccggagatgagaaaaagagtaatacaatgacggccagctggggcgggcttggaataatgtggggcaagaatattgctaccgtatacatccgcccgcagcgctatacaaaggaatttgttgatgcaaatgatctgtttaccgtatcgttcttaccggaaagtcagagaaaagcattgaatatatgcggttccatatcaggaagagaagtagaggataaatgggagatggctggccttcatcctttttatattgatggtaccacagccgtcagggaggccgatctggtattcgtgtgcaagaagcaatatcaccaggaaatgaagccggaattttttgatgtacctgagaacgatacgaaatggtatccggacaaggactatcatgttatgtatatggcggagatcgtaaaagtattgaaaaaggaatgatgaagtaagttttgggaaaaggaatcgcaaggctgatgcacatggggtgagagaccatatggcatcagcctttgtttgattgattttctggatatttcaagatagagtattaatgcaaattcaatgattatctcggaaaacccttgatttacgggcgttttcaaaggattgtaggctgaaattactaccaatttactacttatgattacacatagcatatgattgacagtaatagagcacattgtacatggtttctttattgtatttattcggttgaccgtatataataaaaataatgagtatgaaaggacggtcaatgtatggactatatatctgccccggaagctgctaaaaattggggaatttctgaacggagggtacagaaactttgcaaagaaaaccgtataccgggagttgtccgctttagccggatctggctgataccaaaggacgcgaaaaaacctgaggatggacgtatgaaagcaaaaaacaaacaggaggacaaccatggaatttaacgaaaaactacagcagcttaggactgggaaaggcttgacacaggaacaactagcggagcatttatatgtatcacgaacagcaatttcaaaatgggaaagcggcaaaggctaccctaacattgagtcgctcaagtgtatttccaaatttttttctgtaaccatagatgaactgttatcaagtgatgaactgattacccttgcagaaaccgaaaaccactctaatgttaaaaggatttataacattatcagcggaataatagatgtattggcagttgcgcttatcgtattgcccatctatggagaacctcaaggtaactatttttaccatgtaaatcttctgtcaattactcagttatctaatatagatattggaatacattgggctatctatttacttataattgggctaggaatcgccagacttgcttttatttcttttgataaagaacgcttgtgtagcattatctcaaaagtttctgtcgcaattggggcggtagcaatctgtttatttgcagcggcaagagaaccatacgtaactatactgctatttttgttttttgcagcaaagatatttttattgctacagcaaagtaggacaaaataaaaatagtcataaattccttaaaaacaggctctgacacggtaagtgtcggaactttttttattgtgacagcaggtttcttgcacttcgagttatgtggatagataatcaaagtgagcttgcaagtaatttatcacaaccaaaagaaaggaatgtatagtatgcaaaagaaatcaaagaaatgtatcatcaaaacaggaattctgtttctaatttttatgctttttactgttatgattaagaccattgatgtacagcctatcggaccggaacagtctaaaataggacttgccactcttaatcagtttgtatttaacctttttggagtgaacctactttggtatagcattactgactggctgggtgttgttgccatagtaattgctttggggtttgcaatcttaggactaatccaactcatacgacgtaaaagcatttggaaagttgatccacgcattttattgcttggtgcattttattttatcgtcattgtattttatgttttctttgaatttgtaatcatcaattaccgaccgataattctctctcaaaatttagaagcatcttttccgtcctctcatacaatgattgtaatttgtattatggctacagcaatgttacagtttcattattatttacacgacaagaaaatttgtctatggataatagatatggtttctgttttgattattgcggtaacggtagtaggaagacttatatcgggagttcattggtttactgacatcgtggcaggcattttactctcagcagcattagttactctttattattccaccctaaaatatatggaggaaaagaaaatctaaaaataaataattccatatactgccgaacgacggcaaggtttgaatggcagatccggtgcgagtttaatgcgtactgcaagcgcacgttacgcaatgaactgattgatgcatgccgtgttgctgtactgttttttcaacatgactgaagttgagattgcggaagcaatgaaaagtgccataaggaagcattacagtatatcatgggacattctagcatcaacatgacgttgaactattatgctcatgccatttctgacagtgcattagcggaaatggatcggttgattgcgtagcagtaattagaggttttactacactactatattaatcttgttgatgcagccagaataaaagatacaggcgcgttcgtaacagatttacaattgataatcggcatgataaaatatagaaatcaaaaggaagcattgatgaagtatgtaaaccagaacagagagtattttagcagactggatcaagagacattccaggcagtacaggcgttcttgaattcggggtagaggctggaaatcaggggaatgatattggcataccgtgatatggaaatagcggctcaggagatcgccgtaaaattgatggataagtatggcctatcccagaaggatgcgctaaggatgattcgagattgtaaatagcaagttggaaatagcggataataaaaaattgccgggcagtcctgcccggcatgttctttcttgaagtacaaaaaagatgcttcggcatatttgaaattttgtcatgattttttataatcttgatagaaaatacgatactgcagacgaagtaattaatagatgcaaaatctatcgcttgcctgcgcgggagaaaagacatgaagataacggagactaattttgtagaacaattaaaagagcataatgaaaaggcgctctcttacatgatacaacagtatggaggcctgctttcttccgtggtcaacagacatctgcgcctgttgaaagagtatcgggaagagtgcctgaatgacgtatttttaggcatttggaagaatattggatactacgatgagaaaaaaagtagttttgccaattgggctgccggcattgccagatataaagcggttgactatctcagaaagtattataagaatgccagttatgagaatatcgacgatctggacattccacaagatgataaaggattggaagagatcgtagagcgtgaaatatccgatgaattggaacagatgctaggctgtctgggagaacaggacaaggagatattcctgaagttatacatggaagaaaaggatatggagcaggtgagccaggagacagggctatcaaaaaatgtaatctataacaggatatccagaggcaggaggaagatacagaaagaatatcccggagagaaggaggcataaaaatgaagaatatatatgaattgatgaatgagatcaagacggatacagaagattatccgcaagaagtgttatctgaattcgaggcgaaaaaatggaacaagaaattgtcgaaggaactgaagcggccgagaaggaaaaagtatgcatccatcgcagcatgcgcagttatctgtatggcactgctggcggcagggccgttcagggaacaggtaaaagcggctatgaattcagccatagattccttgaacgaatggctggctatggatattatagatagggatgtttcgccttatacgaacgtaatcaatacaagcgtaaaagatgacaaaattgatgtgaaggttgaagccgtggttgtagatgatcgggaacttctgatatctacaattcaggatttctctaagagaaaagacataaaaaaacatatgaagcagctggatggagatgtggaacggctgggagtatggggactggaatttgactcctttgatgagataagaaaagaattaaaagaaagaccggaagaggatccgatttataacgagattccgtttcttggtactatagtcactctcgatggggagcagataaaaggaacgcagatgattaagccgaaggattatgaaaaggggaagatgcgcgttatatacaggtatgatattgacagaaaagaagcatttgacctgtcaaaagaactggagatgaagattgaattccaggatgtgaatcgtgttagcgatggaaaatgggaatttgcatttaaggctgatggcagagaactggcggccaatacgatgacggtggatctggaccagaaggtagcgctgcccgatggcagcgagatccggctgacttcttataaaaagaatgaactgggaacctatatttactatgaaggcaagacgccgaagaattattcgacacagttcagaggaaccaatgacagagaagaaacggtgtggtttattgattatgggaatggaaggttccagctggatctatggaacgagatgaggacgcaggatattgagagcctgactttatccgtatatagtgcacagagaacttcaaaagaccagagcgtcaaggaaagcagttacaagccatatggagagccgttcacaattcccgcaaagtaggcagaagaaataccaatagaaaaagagaactgcgcctgaatatcaagcgcagttcctgattaagacagacagttattcaaatttgatatactgtacgctataaggcggcagattgatctggccatctagctttacctccaattgggccacaagttccttggcattgccgttcagatcctgatggcaggctgtataaggagtatctgccgcattgatagcaacgatgatccgctccgtatcagagcagcgttcgaataccagctggtggttctgtataatgatattcttatatgagccattgcagagggcatcgctgttctgtcggatgcggattaattgtttgatatactcggtaagttcattcggcataggggtttcgaagcaggggcgcagggcatagtcattgtccggcgccttttccccgggctgcccccattcgctgccgtaatagaggcatgggatacctggcattccaaacagcaggccataggcgagtgggatatgcttatcgttggtcagtatgctggcaagccgggttacatcatggttatctacgaaagtcaccaaatgcttgccccggtaaatgcaccagggatcagggccaaactgccggtgcagggaatgggcgatctcaaaaagattcatagagttaaaactggaataaatccccttgtaacactcatagtttgtgcagctgtgaagcatccgttcatttacgatcagattatagtctccaaataatacttcgccgatcaatacgaacccatcctttaattcctccacataggagcgcagtctttgcataaagccatggtccagactataggccacgtccaggcgcagcccgtcgatgtcaaacgtatccacccagtatttgacacattccagaagatagtctgcgacggccggattctgaaggttcagttttaccaattcaaaatgtccttcccagccttcataccagaacccatcattataattgctgttgccgtcgaaattgatatggaaccagtctttatacggggaatcccacttcttttcctgtacgtccttaaatgcccagaatccgcggcctacatggttgaatacgccgtccaggacgatttttactccatgtgcgtgcaagtctttgcatacactggcaaaatcatcatttgtgccaagtcggcagtcgattttcttaaaatcccgggtatcatacccgtggctgtcggattcaaagatcggattcagcaagatagagtccacgcccagttcctgaagatatcctgaccagtctagcagcttgcggatgcggggaacacattccccgtcattctgcgtaggcgctccgcagaatcctattggatatatttgataaaatacgctgttataagcccacatagtttaaacctctctttcctctaacgaaaatatatgacggaggcaggatatgccgccagttcatattatatcaaaaagagaaggaatatactatacctgccggcatttcgtttgacagcgcttttaagggcagtatataataaaggaagatattcccagagtattagaatagggaaagagaaatacatgcttggcggaaggagcggattatggcggaaaagataatagagacaatggattatggaagcctggtggatcttttcgtgaaatctggcctggagattcatgcagacgatccggtaccagatgggctggtaacttgcttcaggctggaagatgagatcacgggggaacgctatggagcagcaggactttgctttgatgcagaagaatatatcctaagatgcgtggctgtggaagaggcgcaaagaggaagaggatatggaatacgcctggttgacgcggtcatgaagaaggctgaagagatgggggctgtaagaatctggctgacagcaaaagtgccggaattctataaaaagtttggctttcggatcgtaaaaagagaagatgcgccatttcaggcaaaatgtatagagtgtccacaatatcacaatggctgcgactccgaagtaatggtgtatgattatttggaaagaaaaaatgaaccgggttaagattcccggttcatttcgcgtttcaaaaagaataaaaaccatataagaaggagcacgcctttaaatatgctggtgattgtaatgctccaccagattccgttgaggcctaaagccgtttgtgtgaggaccagcgccagaggaatccttgaagcggtgaataggatgcttacgatagaaggcggaatcgtccttccataccctgagaaagcgcctgcggttgtaatctccacgctcatgaataactgggaaacgcccagtatgatcaggtaatcaatacccagcgggattacatctgcttcccgaataaagattcggaagatcggctccggacataggattagcagcaaggtgcagagaacgccccagatgaggacgatacccatggcggaggagtagcccttcttgatacgggtccggtttccggcaccgtggttctgagcaataaaggagtttaccgcggcggcaaatccatccgatgtcatccaggaaatggactctatctgagagcctaccttctgtactgctacggcagcatctccatagcctgctacgagccgggcaataatcatggagattgccgtaaaaatcatactctgtatagaggttggaacgccgatctttataatcgaagccatcgcttttgaatccggctttttacggacatctaccttatgaaagatcaggtcatccttggacgcataatacaagaacatcatcgttacgataaactgcgcgatcacggttgccacagccgcaccgagtacttgcatgcgggggaacgggccgatgccaaagatcagcatcggatccaatacgatgttgaccgcaagtccggccgtcgtggcaaggaatgcggcccggctgttcccaatggcggtaaaaaggccggtgaaggtctggtttaaaaatgaaaagatgacaaatccgcaggtaacttgaagataaacctgggcatctgcaattactttcgggctgttcagccgaaagaagccaatgaagggcgttgagaatataacacaggcagcgccatacaagattccgaataagatggccagctgaagggcgttcgaggcatatcttgatgcatcttccctgcgtcctgctcccagtgcatgcccgacattgacctgtccgcccatcttggataaggcagccagtccgttggacagccacatatacatgcctgcggcgcccactgcagcaaccgcgttgcttccaatctgcccaatccagatcatatccgtcagattataggccatctggatcagcgaggttgccataataggaatggccagcctggtcagtgacggcaggacaggcccatttagtaaatctacatttttctgcataataatatcccccgagaaaatacttgaaaatcaaagcgaagatattataacatataaaatcaaggaaagacaggaagattctgacaaaaaccacagaaaaattccagaaaaatggttgacacgcgtggcaccgtataatataataaggcagtatgacaaaaggagaaacagcacgaagccaaagccccggagtcttgctgatttcgatataattatcatgaaaatgttaatgattcacaggaggtaaaccaatgaagacttatatggctaatccagataagattgaaagaaaatggtatgtagttgacgctacgggatatacattaggacgcttggcatcagaagtagctaaggttttaagaggtaagaacaagccggaatttactccgcatgtcgacacaggcgattatgtagtagtagtaaatgctgagaagattaaagtaacaggcaagaagatgaatcagaagatttattacaaccactctgactatgttggcggaatgagagagaccacgctgtctgagatgatggataagaagcctgagaaagtaatcgagcttgctgtaaagggaatgcttccaaaaggacctttaggaagagcaatgattaagaaacttcacgtatatgctggaccagagcatgagcagcaggctcagaagccagtagaactgaaattttaaggagaggttgaaaggaggacattacagtggctaaagcaagattctacggaacaggaagaagaaagaaatctatcgcaagagtatatttggtaccaggaacaggtaacatcacaataaataagagaaatattgatgaatatttcggacttgagactttaaaggttgttgttcgccagccgttggttgcaacagagacgaatgataagttcgatgtgatcgttaacgttaagggcggcggatacacaggacaggctggagcaatccgtcacggaatctcaagagcgcttcttgaggcagacgcagactacaggccagtgcttaagaaagcaggattcctgactcgtgacccacgtatgaaagagcgtaagaaatacggtctcaaagctgcacgtcgtgcaccacagttcagcaagagataatctgttattattaatgtatataaaacccacagacttgatgtttgtgggtttttttaatacgataaatatggtttgccttattatataaaatttcttacggatataaagtaaactatatatcataatgatgaaaaagataaaatagaagaacaatgaatagaatcaatcatattatgctttcaaaaactgtacaggctgtactaaagaaagattattcggtacatattgattttgaagatggaaaggggctatcgcactcattacttagagcgacagcctctcattttaataaaattgtaaaccattgcaatggaagagttgacaataaaaaggttattgtttatagttactaagaagattgcaaaggaggaaaagtatatgactttagtagaagaattaaaagagagggttatgagtaatggaagactgtcaagagaagaagcctgtgctcttttccgggaaccattagaagaacttagccgtgctgcggacgagatcaggaggcattattgcaaagacgggtttgatatctgtacgatcgtcaatggaaaaagcggcaggtgttctgagaactgcaagtattgcgcgcaatcctccttctatcatacagaggcagtagaatatcctcttatggatgccaaagagatcttggataaggctatcgataatgccaggcgcggggtgctgcgctattcgatcgtgacatcgggaaggcgccttggcgataaggaaattgatcagatgtgcaggactatccgtaaaattaaggaaacagtgaatatcgagatctgcgtttcttttggacttctcgacaaggaacagtttgtaagacttcgggatgcaggcgtatcccgggtacataacaatctggagacgtccagaaagaacttcccgcgtgtatgcacaacccacacctttgacgataaagtggcagccatccgcgccgcccaggatgcggggctgaatgtgtgcagtggtggcattatgggacttggcgagacggaagaagatcgaattgatatggcgtttgccctgaaagagttaggaattaaaagcgtgccgatcaacatgctgaacccgattccgggaacgccatatgaaaacgtcccaaggcttaaggaagaagaaatgaaaaggatcgtcgccatataccgctttatccttccgtctgcttccataaggctggcaggaggaagagggctgcttgcagataaaggggaaggatgctttcggtcgggagccaatgcagtcatatcgggggatatgctgaccacctcagggtataccattgagtcggatttggagatgatcgggagattagggtacaggacagccctctgtaacgggtaaggcctttttccatttttccataggctaatagcataatctgtgataaaatagaaagcatataattgctgcacaagaatgtgacggattgcggcaaggaagaaaggatgatgaggatgggggaatttgtaatcagctgctgttcaacagcagaccttacagaagagcattttaaaacacgtaaaatatcatacatctgtttccattatgaactggatgggaaagaatatgccgatgatcttgggaaatcacttccctttgaccagttttaccaggcaatgatgaatggcgcccagaccaagacgtcgcaagtaaacgcagaagagtttacggaatattttgagggattcctgaaggagggaaaagatatcctgcatgtatgcctgtcatcaggcatctctggcgtaatcaattcggccgtgattgcaaagggagacctagaggagcagtatccggacaggaagatttatatagtggactcgctgggagcatctgcgggatatgggcttttgatggatcagctggcagatctgcgtgatgaggggaaaagtattgaagaagtctatcaatgggccttggataacaggctgaaactacaccactggttcttttctacagacttgaccttctatatccgaggaggccgcatatccaagacggcgggatttatcggtggagcattgaatatctgcccgctgcttgatatggataaggaaggacatctggttccaagatttaagatacgaacgaagcggaaggtaatcaaggctatagtagacaagatggaagaatatgcacagggcggccttgaatattcgggcaaatgttatatctcccactcctattgctatgaagatgccaaggaagtgtcccggcttattgaagagcggtttccaaagctgaatggaaaagttgagattaataatgtaggcacgaccataggaagtcatacgggtcccggaaccgttgcgctgtttttctgggggagcgacagaaactaggagggtcgggcttgattctcctgaagaggattccttaccacttaccgctggtttccataccacttgctgaaatattgtttactttccatcccagttatggttagataacaccagggagagggaaagatgaaaatacgcatagaaatcgaagacaacttaacagaggaagagattattatacgcagcggcagcctgaatgcgaaggttcagatgatccagaaggctattgccgaggcgatggacaaagagcagaagatgtcattctttaaaggggacacggaatattatctgcagcttgccgagattctgttttttgagacagaagatggagaagtatatgctcatacgaggaaagagacctaccaggctaagtaccgcctgtatgaactggaagaggctcttcctggatattttatgagggtgtccaagtcgacgatattaaatacgaagagaatctatgcgattacaagaacgctgccctcatcctgcacggtagaattccagggtacgcacaagcaagcgtatgtatccaggtattactacaagccgcttagggatagattggaagaaaagaggtaaggatatgaagaaggaacggatattttggggattattttttatagttgcggcaatttttctgcttgtaagccggctggggttcctgggggacataggcttatggagtttgctgcttacggtattctttgtcgcatgcctggtaaaaagcattgctcataagagtgttagcggcgtgctgttcgcggtggcgttcttatgcattgtatacgcaaagcctctggggatcgaggcgattacaccgtggccggtgcttggggcggctgccttaggaagtataggaatcagtttcttataccatcccagaagggattacaggaactatggatgctggggacgcggcaatcattattcaacggagacagaagagactgtggatggaagccagatggagtttagtacttcatttgcaggcagtatcaaatatgttaattccgatgatttccagagtgcggacttaaaatgttcgtttggctcgctgaaggtgtattttgacaatgctatgattcagactggcgcggcgaggatattcctggatgtttcatttggcggggtcgaattgtttgtacccaaggaatggaacgtggtgaataatgtaagcgcatcttttggatctgtggacgagaagaattccagcaggagttcaggagtacctgtagtgacgctgacgggaaaggtaagttttggaggcatagaaatagtatatatttaaggagcaatcaatagcagctatacttttgaaattaagaagactcggttgcaagaggcaaggaaaaaaggatttccttgcttcttttttggatgaaataagattccgatatacattgctataaaatgttcttgacatttctaactgtacatgataaagttacagtaataaatgtaacatttaaatatacagtttgaaaagaggtatggaaatgaaaaagtatcaggatattatcattggttttggcaaaggcggaaagacgcttgcaacagcactaaaaaaggcgggacgggaagtcgcgctgattgaaaaatccgatcagatgtatggaggcacctgtattaatgtggcctgcatcccatcaaagtttctggagaatgaagcacgcagatcaagcatgataggcggaagttttgaagataaggcacggcgctataaacaagtgatccaggaaaagagagaactggtaggaaagttaagagataagaattataaaaaactggcagaagcggcaggagtcgatgttataacaggcacagcattttttacagatccaaatcatatcatggtcgccaatcaggatggaatgacagaggaattggaaggagataacttctacataaatacaggcgccaggccatttattcctccgattaaagggattcatgaaagcaaccatgtctacataagcgagactcttatggaagaagaacgtcttccgaagaacttagtgattattggaggaggatatattggtgttgagtttgcttcctactacagcaattttggctctcaggtgactgtgattcagaatggaaaagattttatcccaagggaggatcaggaagtggcccaggccgttctggatcttctgaagaaaaagggcgtacggattatggaaagcacggaggtagagtctgtcagagatatggatgatgtggcgcttgtaagcgtaagccagaatggcaggcaggaaatactgcgggcagacgcagtgctcgttgccaccggacgtcggccgaatatagaaggattgaatcttgataaagcaggtgtggatctgacggacaggggagcaatcaagacggatgaaggtctgaggactacagcgtcgcatatctgggcaatgggagatgtggtcggaggcctgcagtttacctatatctctttggatgactccaggattgtgaaatcccaagtgctgggagagggagaacgcacgacccagaatagaggagaagttccctacagcatctttgtagatccgccgttttcccgggtagggcttacagaaaagcaggcgctggaagcaggatatacgataaagaaatcggtacttcccgcacaggcgattcccaaggctctggtgattggacgccccgagggccttctgaaagcgattattgatgaggagacaggaaagattcttggcgcgcatttattctgtgcagaatctcaggagatgatcaatatcattaagatggttatggatgcgaacctaccctatacagtgctgcgggatggcatctttacccatccgacgatgagcgaggcgttaaatgatctgttcgcgttataaggtgagaatatttcaatataaagaagcgttagaaattttcaggaaccttcccgatggaaggttcctgttttgctttccacgagagttttgcggctcggtccgtaatctggcatgcatgtaaataactgctttctgcatgttaatctaattcaataataatttaatgataatcattaaattattattgaataaaattagagtatatggtataattcagataggttaaaaagaagaggaaggagaggatcaaatgtcagaggaagagattcagatggattgcgaaaagacagaaaaaaaggaattttcaagaggatttcgaatattgctgtactttgctatagcaaatacgggatttgcaggacttagtgcaatatattatataccttgggcgctgagaaatcatggatgggagatggatgggatgacatatttttgctggaactgcatgttctatgtgattatgctgttctgctttattattttagtgaaaattgccgtttccaagagaccattctctggcgcgctggtaacgcttttttacggagtaggcctgctgtttatcaccggatctgccatatttccaagtttgccggggtatacgcggccgcatatgctctcgggggttgaaggaggattttatatcgatatgattccgtttatggcgggtctggtattagtcctcttcggaagaattctgcggtatggattcgagtatcaaaaagagatggattctattctgtagaaagcggggggctgtgacatggcaattatactaagacttgaccgggtgatggcggaccgcaagatgtcactgaatgaattatcaaaggaagtgggaatatccaatgtaaatctttcaaacctaaagacaggaaaggtaaaagcaattcggttttctactttggagtctatctgcgatgtgctggactgccagccgggagacatattggagtatcgtcgggaaacttaaaatcaggtgtaagaatgtgctttggcacattctttttttgataatatattaaactgataataaaaaataattagattatatcttaataaaattaagaattatattaaaataattaatttaataattgacatttttaagaatatggattatattagtcttatcagaagggaagtggatgtatgagaaaagtaatcagccggtgtcctgtgtgtggaggagaactgaaagtaacccgtttaaaatgcgaggaatgcgaaacggtgattgagaatgactttgtgctgagcaagttcgattacttgtctggagaggaactttattttacagagacctttatccggtgcaggggcaatatcaaggaagttgagaaagaactaaagatatcctatcctactgttcgggcgaaactggatgccataatcaagaaactgggatatgaagatgaggcaaggcaggacgaagagatgatgaagcgcgaggctgtgcttaaggcgcttgaacaaggggagattacagcggaagaagcaatcaggcaattaaaataagaaatgaaaataatctatgaaaaaggagaagaattatggatgagagactcagaatattaaaaatggtggaagatgggactattacggcagagcaggcagccgagcttatgaaggcaatgggcgtggaagaagaaagccaggttccggcaaagtcccaagtcggctatgataagaagatgttccgaatcatcgtagacagtgtggatggcgataaagtaaatgtccagtttccggtgggcgctatcaagaagatcctgaaagtgacaggcaaacttcccattgcggataaagatctgcagggagtggatctggagcagatgatggaggccatctcggaatgcctggatgaagagatcgaaggcgattttgtcaacgtcaatgcggcggacggtactactgtaagagtatatgtagggatataaaggagcagtctatgagagtaatcgtgagatccaaagatgcgaatttcagaatgcctgtaccaatcgggcttgcttctgttgttgtaaagttgattcccaaggctgtatttgataagatgggcgaagatgtacctaagccatatgacagccttgtctcaaaggatatcatttgcatgatctttgaagaatgcatggatgtgctgaaagagaacaaaggcttggaaatcatacatgtagaagcagtagatggaacattcgtttctataaccctataaaagcgccggataaaaaatcagaattccttaataaaattccattctttattttaagaatccttggctataattttcttagataaaggagggttgaggatgctgaatgtatttacgctatatagtctggcaagtatgctccttccctgcatggtctatcagcttattgtgatagtcaaggcgcgcaggaacgggcagagatgccaggctgtacatgttatctggatctatattttcctgatatatatctggatggtattccaggtgacggggatcgggcttctgggagatatactaagaacggatacggatcttattcttgggggagtgaattttgttccttttgattccattgggattggctatatcttaaacattattatgtgcatgccattgggatttttgcttccattaatctgggaagattgcaggaaattggggaaaacggtgctgataggagcgggattttcattgctgattgagattacccaactctttaactatcgtgctacggatatcgacgacctgacagccaacacgcttggagttttattgggatatttcatatggaagatatttgtgcggctgttcggtacccggctgaaagcgaaagccataggaaggcaagaggcgatcatctatatattgctgtcggtggcaggaacctttttgctgtataatccttatttgttgttttagatacttatacgtttttaaagaaactatattctggcgctatgcggcggaatatagtttctttttacgtcttgacaaatcgatatatattatatataattcaaaatggtctgtattcggactaattaagcgcacttgaattgtgtaagaaaatgtaacgaactataaaattgtgaaacgaggagcatgaatggaacatatattggaacaccaattaaaagaactctattccctgtggaatgggatcaatggattatacacaaaatgggcccaaaaaaggggaatgtcatactattccgtatttgtcctgtacgcaatctacaattcagaaggcaaatgctgtcccaaaaggatatgcgacgagtggtccatgccaaagcagaccgtcagcagtatcttaaaaaaatttgaatcagagggttacattttcttagttacagatgaagatgacaggcggaataagaagattatattgacagagaaggggaatcggtttgcgggaggtctgctggatgaactataccgtatcgaaagttctgtcatccagaagataggtccggcggatatggaggagattctccggggaaaccgactgttttatgaatattttcaggaggaaatagattaggaatcatgaaggtagtaagaagagagttttggaaaaacgtgctgccgtctatgattgcatttgcatttacaggaatatatgcgatcgtggatggtttttttgtgggcagaaatgtaggagatgcaggactggcagccatcaatatggcttatccgctggtggcgctgattcaggcagcaggctcgggacttggaatggcgggggcgattcagatcgccatcaacaaaggaaagaaagatgagcaagaagagcgtcgatacctggggaacgctatcatactgctggctgtagctggaatcgtgcttatggcagggcttagccttgcccatataagaatattggagatgtttggcgccacaggagagatcctgtcctatgccggcatttacatcaagattattgccgcaggggctatgctccaggtattcagtacaggcatggtcccgctgatccgcaactatgacggggcgatgaccgctatgtgcgctatggtagccgggtttgtcaccaacattatctttgactggtatttcgtatccatcaaaggatatggcattgccggagcagcagcggccactttgataggtcagatggtaacagtcgttccatgcatggtttatctgatagttaaagtgcgcctgatgcgctatgcaatattcaagcctgcagcgaatacgataaaatatctcgcgctgatagcgatatcgccctttggccttacgctgtctccgaatattgtcatcataattatcaataaaagcgcgattgcctatggcggagaactggcagtgtcctgctatgcagtagtcagctatgtcatctgcgtggcccagcttctgatgcagggaatcggagatggagcccagccgctgattggcaggtactatggcagttcgaacaaggaagaaatgctgcatgtgcgcagaatggcataccgatttggcgggggagtgatgcttggatgcgtcattcttctgtatctgaccagatctaggatggcgggggtatttggcgtatcagaatccgtagagaaattgtatggaacggtgatactgtattttgcggcaggcttgatctttgccgcattcttaagagttactacctcatatttctacgccgtggaacagaacctggaagcatatgtgctcatctatggcgagccgctgcttctttcgctctgtatggcattcctcttcccaaagatctggggccttgccggagtatggacagcgccggcatttacccaatgctgtctggcactggtgggactcatcctgctaaaaatgctggacaaacgaatgcttgggaaggtaaaatgagcacgtgagcacgtaacagaattgaaaagtgttacgtgttaaattgaaaactgcacgtaacaaagttgaaaagtgttacgtgtcaaaccaacacaactggtgtgtaaaattgatcgggaggaggatatcgtatgggagagcagttaacgcaaagcgacgtcaagaagataaaggaagagattgaataccggaagctggtggtccgcaagagggaactggaagcggtaaaggaggcccgggcccagggggacttgagcgagaattttgaatacaaggcagcgaagcaggataaaaaccgcaacgaaagcaggatacgctacctggagcggatgctcaagaacgccagaatcatctcggatgattctggggaagatgaagtggggattaataatacggtagaggtatatttcgagggcgatgatgagacagagacctaccgtcttgtcaccagcgtgcgcggcaattcccttcaaggcctgatcagtatagaatccccactggggaaggctatcaaaggtcgaaaggcgggggaccgcgtaaaggttaagaccaatggcgacaacggctattacgtggtggtcaagaagattgagaagaccacggatgattccaatgacaccctaagaaaatactaactggcgaagggcgccaaggaagaactaaaatgcgattcctccggaaatgctgtacatctccggcgcaatcctgtgtgtggaaatttgtaggcaacgattgcgttaactggcagagacgcccagcccatgatgagcatacagaaactatcatctaaaaaaatatttaactgattggctatacaacaaattgcggaaggtaaaattgtggaaaaaggttgcaaagaaactggaaagtagtataattaacgttgtataaaacagaacaacggggagcttgcagataggagcaggctgagagtaggctgatattgccttgacccataaacctgatttggataatgccaacgtagggacataacgtatgtaatcagacggatatgccgaaggcggcatatccgtttttcatgcgcaaaaggaggaaacaggaaatgctgggaaagtgtttggacaatgtaagaaagacgatgccgctggtacataatattaccaattatgtgacggtcaatgatgtcgcaaatgtgctgcttgcctgcgggggaagcccgatcatgtccgatgagccggaggatgttcaggatattactgccatctgcggcggattgaatattaatatcggcacattgaataaaagaacgatagaaggcatgttcgtggctggccataaggccaatgaattgggccatatggtgcttcttgaccctgtgggggcaggtgccagcgcgcttcgcaccaatacggctgtaagactgatggaggaacttcatctggacgtcatccgaggcaatatctcggagatcaagacgctggctcttggaagcggtaccaccaaaggcgtggatgcggatgtggcggatgcagtgacagaggaaaatctggacgaagccgttgtgtttgccaaggagtttgcgaagacctccggatccatcgcggcaattacgggagccatcgatctggtcagcgacggacaggagtgctatgtgatccgcaatggccgtccggagatggggaagattaccggcaccggctgccaactctcggggctgatgactgcttttctagtggccaatcccgaccagaagctaaaggctgcggctgccgcggtctgcgcaatgggacttgcaggagagatcggatggaatttaatgcaggaaggagacggcaattccacgtaccggaaccggatcatcgacgcgatataccatatggatatggagactttggataaaggagcaaaatatgaagtgcgataagaaagacctattattatacgctgtgacggacaggcattggctgaacggcaggacgctatacagccaggtggaggaagcgctaaaaggaggcgccaccttcatccagttaagggagaaggaactggatgaggagcattttctggaagaagccaaagaaatcaaagaactgtgcagacgctatcaagttccgttcgtcatcaatgacaatgtggagattgccctggcagtagatgcggatggcgtgcatgttgggcagagcgatatggaagccggggatgtgcgggccaagctggggccggacaagatgatcggcgtctccgcccagacggtagagcaggcggtgatggcagagcaaaatggcgccgattatctgggagttggcgcggtgttcccgaccggctcgaaagcagatgctctggaagttagccacgatacgctgaaagccatctgcaaggcggtaaagataccagtcatagctatcggcgggatcagcaaggagaatattctggaactctccggcagcggggtctgcggcattgccgtcatcagcgcgatttttgcaaaggatgatatagaagaagcggccagggaattaaggggcctgacagaggagatggtaaccgcatgataagaggcgcgatatttgacgtagacgggacgcttcttgattccatggcaatctgggaagatgcgggagccaggtatctgaaagggcttggcatccaggctcaggaagatttggggaaacttttatttcccatgagccttcaggaaggggctgcctacatgaaggacaggtatgacctgaaacttagcgtaagccagattatcgaaggagtcggggatacggtaagagactactacttttatgaggctcctctaaagaacggggcagccgatttcttggggaaattgtcaagaaaagatattcccatggcggtggcaacatccagcgagttggagcatattgaagcggcatttaaaagactgaatgtgaatcaatattttcagaagatttttacctgctcccaggtgggcgcaggcaagagcagaccggatatctactttgcggccggcaggtatctggggacagagccccgggagacctatgtgttcgaagatgtgcttcatgccatcgagacggcggataaagccggcttcaagacggtgggcgtatacgatagattcagcgaattgaagcaggaggagatccgaaagcactcggatatttatcttgaggacttgaccgattttcagacattttgggaatatgcatccaggtgatgcttagaccggcggcagattgggggcaccaccttctgtcgcttgataaaattaatgcaggattttatgaggaggatatgtacagatgagaacagcattaacaatcgctgggagcgattccagcggaggcgccggcatccaggcagatatcaagacgatgatcgcaaatggcgtatatgccatgagcgcgatcacagcgttgactgcgcagaatactaccggcgtgacaggcattatggaggtgactccagattttttagcagaacagttagatgatatttttacggatatctacccggacgcggttaagataggaatggtatcggcaagcccactgatccgcatcatcgcggaaaagttaaaagtttacaaggcagacaagattgtcgtggatccggtcatggttgccaccagcggatccaggctgatcagtgacgaggcgattgagacgttgaaagagtgcctgcttccgatggcaagcgtgctgacgcccaacataccggaggcagaagtgctgtccggcctggcaattgagacgcaggaagacatggtggctgcggcgggagccatcagcaggacctattcctgcgcggtccttctaaaaggaggccatcagatcaatgatgccaatgaccttctgtaccgggaagattcttataaatggttcaatggcaggcgcatagataacccgaatacccacggcacgggctgcacgctttcaagcgccatcgcctcgaatctggcgaaaggatttgaccttgacgcctctgtagaacgtgccaaggcgtatatatccggcgcgctgggcgcgatgcttgacctgggacggggaagcggcccgatggatcacggatttgccctgacgggagagtttatccaggagaaggaagagagaattgctcctgattcaaacaaaggggaggcgtgctaggaaatggaagaaaagcgtacctctatatttgaaaatggactgatctggtttggcgcaggggtatcaattgcggagattctgacaggtacctatcttgcgccgctgggaattaaaagaggactggcggctatcgtccttggccatatcattggatgcgtcatgctgtttctggcgggcgtgatcggaggcaaggccagacgaagcgccatggagaccgtgaagatgagcttcggccagaaaggaagccttctgttctctgttctgaatgtattgcagctggtgggctggacggccatcatgatctacgatggagcgctggcggcgaacggcgtggtccgtaccggcagatgggcatggtgcctggtcatcggcattctgatcattctctggatcatgattgggatcaccaatcttgggaaagtcaatgcctttgccatgacagcgctctttattctgacgctgattctgtgcaaggtgatcttctttgacagtggtgccataggcatggccgccgatgacagcatgaccttcggagcggcagtggaactgtctgttgccatgcccctatcctggcttccgctgatcggcgattacaccagggaggccagggagcctgtaaaggcgacggcggcaagcgctatcgtatatgggcttgtcagctgctggatgtacgtgattggaatgggggccgcgatctatacgggagagtatgatattgctcagattatgctgaaggcgggacttggcattgcaggccttctgatcatcgtgttctccacggtcaccacaacctttctggatgcatattccgccggaatatccagcgaatctatcatcgccaggtggaacggaaagcatgtggctgtcattgtgacggtgatcggaacgattgcggctatcgtgtatccgatggacaatatcacggacttcctgtatttgataggctctgtgttcgcgccgatgatcgccatccagatcgcggacttcttccttttgaaaagggacagcagcaaagatcgggccaatatccccaacctgctggtatgggctgtgggatttgctatatacaggattctgatgcacatagatatgccggtaggcaatacacttccggatatggtaatcaccattcttctgtgcctgatcgtaagcaggattctgaagcagaaaaagtagttcctgattaaaaataatagtagaaaataggcggttgcaaccaatagttgacaaatagttggtagattgcaaccgcctattctgttatgcttgttacatggaggtgagcaggatgtcgctaggaaaaaatatcgcatccaggagaaagagccagaatttttcgcaggaagacattgcgactctggtgggcgtaagccggcaggcagtctccaagtgggagaaggatctgtcaagccccagcacggagaatatcatacgtctggcggagattcttcgggtatccgttgaagaactgacgggtggccgcccggcggcagcaggcagagacagagaagacaggagcgtgtaccgtgtgtcagacagtagatacctgtggcttctgatcaaagaccggttattcatcaggctggccaacccggtgctgatattcttgtatctggaaacatggcagaccatgtaccagttagcctatatcggaatgctgaaaaggaatcttttatggctgtccatctattctttcggaatattgctgtttatcctggaaggggcagccgctgtctatattgcggcaagacgccgggtgatccttggcggggaatccctggaactgtcggaagagggtatcatcgtggtggacatgtcctaccgcaagaaggcggacatccactggcgggaagtaaagcgggtaaaggaaagcaggcattattatttccttatcctggaagggcggcgttttctgccaattcccaggcaggatatgacagaggcccaggagagtctgctgaaaaagcatgccaggcgcgtccggggcataaagctgcgcatcgtgattgcagcattctggatattcgtaacagcatgcggcacctttgccgtaggaaggtgcatggtgaatctcaatggaaagctggcctggaagattcaggaggcaaagacggacaaaaaggtaaggcttaaggaaaagaacttttacaaaaccgggctttcaggaattatggatacggtgcaaacgaaagtagaactgatgcctcaccttatgaccgagaatgtggatattatatttaagaaggatggagagattgaaagcatctatgccttcatctatggatacgatatggactataagctcaggactacgtatctggtatcctacgagccgcagacagacaagcggatgctgatacacactcaagactggacgggagtcgataagagcgagcagaaagaatacgatccggacaatgatatggagatactctttcaaatggcggagaatattaatgtccaggatgtagtaaggcagtgggatgaagagcgttacggattctattacaaaggaattgcatcctggggatatctgggagcggcggatggcatccgctatatcgaccagaaaggaaaggttacgctgcctgacgattattcaagcgtggaagtgaaggggccaagcctctccatctactgcccagataagaaggaagaacggacgcccatccgatttgtctatgcaccgtcggaaaccatgtaatacgtgccaatcaggaacagaggatacgactaggaagaaggagaacgagtagaatgagcaagtacagaaaaatggcaggagtcatagccttatgcgtctgtgccgcggtgctgtgcacgggatgcaggtatcaattttttgagcagattccggtaattggaaaactgtttaaggacgggcaggatgtgaagccgggctacacggattcaggacagtatgacctgccggcagccctcaaaaaggcaaaacgtcccgagtcttttaacgaaaatgttattaacgaaataaaaaaattgacgcctttggaggagtcggatgtcattgtgacagaagaccgctatgagagcaaagatgtgcagtctatggagattccgaagaacccatacgaggttctggctgcggatccggatgactatgcagccgctgctgctaccatgctggagcggtattttgcctcctatctctatgaagatacagaaactattgacgagccgaatattccaaaggagaagtattactcttatatcgaggtgcaatggtccaggccgctgaccggaagcagggaggaatttgctgttgctgccgcagtcaagatccacgatgtaaacccggaggataccatatatacggaatttggggaaatcggcaatgacaatgccatacactgcaaccttacggtatatggcgaacaggctaaggattatacctttaatctgaagggaatcgcgcagacggaggatgtattaaacgctattgaagaaaagttccagcctgtccgggcagaggcgactcctgtttcgccggaccggtataagatagagggagagactctgtccatttcctatgacaacggagttacctggaaaagcgttcctatcacgatggatcagttgttcggggaagatcctcagacagatcggacctctcttttaagcggcagttattatattgcgccagataagacctttttcgtctacggaggacgggaaaaaatgccggtcaccatgatcgtgtcggaggatgccggtgaggcatggaccaacaaggaagtgctggatcaccccggcgttagacgtagttatgcagggatgagcggggatggcagttttatctatgcgctgatgtgcgtggataagaccatggggtccgaagcgaccgtactctctgtcagcacggacatgggaaacacatggacagccaaaaagccgatcgatgattttatgacgttcctagtaaatggctttaccttctttgacagcatgaatggaatggcggcggtcacggatcatgaaatgctggactttaagaggacaaaagacggagggaatacctgggaggaagtacgtatggatcctccggcagaggggtggaccatggtttatgccccgcagaaagaaaatgatacatggatattctacgtagggcaggatggatacgaagaaatggcgggcgtattatacaagtatatcagcacggatatgggagagacttgggaaaatacgggaagggtaatattgtagaataagaatcgatgcttgcctttctggaatttctatgctatcctatccaaagaaaaccaagatgaaatggagatgagaggatgaggacagcttcttgctaatggaaacgtaactgcatagcaggatgtacatggggattgcatgcccattcgttttgctgtgcacggatagcaggaaagttgaacaaatccatctgctgggcaggcaattcattcgtctttaaatagagaatattttgcgtacgttattacgtagtgaccgactttgcgcatccatgctgcgggatgctaaaagaacgtgctgccaaggctgcagggaaggctttcctgcagtctttttttgataagttttaatagttgaatgggggcatgcattatggcattgatagatgtagtagatttaagcttcgcctatgagggaagttatgataacgtatttgaacatgtgtcgttccagatagacacggactggaaattaggatttgttgggcgtaacgggcgcgggaagacgacatttttgaatctgcttttgggaaactacgaatatcaggggaggatatcttccaatatggaatttgcgtattttccatatgaagcaaaggataaaaggcgtatgacgatcgagattttagaagagatctgccccggctttgaacaatggcggatttaccgggaactgaatctgctggaggtggcagcagaggtcttattccgcccttttgaaacgctaagccacggcgaacggacaaaagttatgctggccgtgttatttgcaggcgaggatcgattccttctgatcgatgagccgaccaaccatctggatatggaagcaagggataaggtggcccggtatttgaacagcaagaaaggatttatcctggtatcccatgaccgcaggttcctggatgcctgcgtggatcatatcctttccatcaacaagatggatattgaggtgcagaagggaacttttagttcctggtatgccaataaagaggcaaaagaccagcaggagatggaacaaaatgaaaaattgaaaaaagaagtccgacggttaagccaggctgccagacgctccggggaatggtctgacaaagtggaaaaaagtaaaaagggccagcgggtagcaggcctcaggccggatagggggcatatcggacatcaggctgcaaagatgatgaagcgctccaaggtgttagaaggccgtaggcagcaggcggttgaggagaagtcccggctgcttaaaaatattgataccgcagaagaactcagactctatcccctggaatatcatacggaccggctggcagaatttaagaatgtgtcaatctcttacgatggacgaaaagtatgcgaaggcgtgaacttcgaagtaagacgcggggaaaggatctgtctgagaggaagaaatggatgtggaaaatccagcatcctgaagatgattctgggagaaaagattccatacaccggagaaacgcaggtcggaacaggaataaagatatcttatgttccccaagatgcttcattcttgcagggaagcctggaagatatggcgctggaatatgatctggatgaaagcctgtttaaggcaatgctgaggaagctggatctggaaaggagccagtttgataaggatatcgggcagtacagcgctggacagaagaagaaggtgctgctcgcaagaagcctctgccagagagcccacctgtacatctgggatgagcctcttaactacattgacgttctctccagaatacagatcgagcagctgctgatggcatataagcctgctatgatcttcgtggagcacgatgcggcattctgcgagaaggtggctacgaagcaagtgcggataggcaatactgggggagaataatttttaggacattttgctcagacatggattgcgaacgtaagttcggcgtggtatgatacatgtatatggaattagcagctcatactattagcaagtgcgggaggaattaagatggaacagatgtccttgtttgacgaccggcaggccagcgcgccgctggcaagccgattaaggccctcttctttggaagacttcgtgggccaggagcaccttcttgggaagggaaggatgttaagacagctgatcgagcgagaccagatatcttccatgatattctgggggccgcccggcgtaggaaagacgacgcttgccagtatcatagccggacgcacgaaggcggattttatcaatttcagcgcagtcaccagcggaatcaaggagatcaaggaggtcatgaggcaggcggaggaaagccgctgcatggggattcgaaccgtactattcgtcgatgagattcaccggttcaataaggcccagcaggatgccttccttccatttgtggaaaaagggagcatcgtcctgatcggcgccactacagagaatccctcctttgaagtgaatgcggcgcttctttccaggtgccgggtattcgtgctgaaggctttggaagagacggatttggtaaaattattgaccaatgccctgaatagcccggcgggcctaaaagaccagaatgtccggattacgcagcagcagcttaaggccattgcggcgtttgccaacggggatgccagaacggcgctgaatattctggagatggcggtgcttaacggcgagatcacggcagatggcatgacggtcaccaatgaagggctggagcagtgcatcagcaagaagtcccttttatatgataaaaatggtgaagaacattataacttgatatcggcgcttcacaagtccatgcgtaacagcgacccggatgcagccatctactggatgtgccgcatgctggagggaggggagaatcccctgtatatcgcgagaaggctgatccgttttgcaagcgaggatattggaatggcggacagccatgctcttcaggtggcagttgcggcctatcaggcgtgccattttctgggaatgccggagtgcgatgtgcacctgacccatgcagtcacctatctgtccatggcgcccaagtccaatgccctctatatggcgtgcgaggcatgcaagaaggatgtaaagaatctgcgtgcccagccggttccgctacagattcgcaatgcgcctaccagcctgatgaaggaactggactatgggaaaggctatgaatacgcccacgatacagaagagaagcttacgcatatgcagtgcatgcctgagggaatggaagacaggaaatactaccggcccaccatgcagggagaagaaaaaaaggtaaaggaacggctggaagcaatcgaggcatggcgcagaagttaacatagcgggaaagtccccggctaaaaagactaggatgaagaaggatggaaagaagatgaaagaggaaaaaagcgcatttgagagaatctacgatattatccgagagattcccgaaggaaaggtggcttcctatggacaggtcgcagaacttgcgggaaaccgccggtgggcacgggtggtaggctatgcccttcatgctgtgccagaagacagcgagcttccctgccaccgggtggtaactaaggatggtaatgtatcctgcgcctttagcggcggcatctgcaaccggcagatggaattgctgaaaaaagagggggtaggatttatagacgatcatgtggatatgcgacgctttcaatggtcgaagcgcctattctgatgcttgggctcgcaaggcggggtctgaccgatccatctttctaaagattaagattatttgaatatcgtcctgcatagggaatttatagagaatatcatgctataatatttcccgaaaggcagggcgatatttttatggaaataaagaaaaagatgctggcagcggatgatgagccgggaatcatccatctgttaaaggattattttgaaatgcaggactaccaggtgatagaggccgaaaatgggatggaagtactggagaagatatcccagaacccggatattattcttctggatgtgaatatgccaggattggatggatttgaagtatgcgagagaatccgcgcgcatgtctcctgccccatcctttttttgacggcaaagatagaagaggctgacaggatcaagggcctgatgctaggaggcgatgactatatattgaaacccttcagtatcgaagaactgggagcaagggtggaagcccatctgcgaagggaagaacgaattaagcgcaaaaagccggtaaagatctgtggagcgctgacaatacgctatgaagaacgctgcgtatatatcggggaagatttgcttggtcttaccaagacagaatatggaatcctggaacttctgtctctcaatccaggacaggtattcagcaaagagcagctctatgaaaaagtccgggggtatgaaggggatgcagatgcaggcatcataacagagcatatccgaagaatcagggcaaagatcagccgttacacagataaggcatatattgagacggtatggggagtggggtatcgatggattggataaatgagaaatttgaaaaactgttttcctgggtgaggaatcttactttccgcagggcaatgatcgcttatatcctattgacatccgttatcgtatgggcattatcttttgttacaatgcgcctgtgctggcagtgggagaacagtctgtggaaacaatatgacagtatcaatgacttaggcaatgtcatagttgaaaatggcttgatgtggatgaattcgatgtggaggcagcaggtagatggcaggctgatcgtattggatatgatccgggtgtggtgtccgttcttctatttcctggcaggaatcattgtggcgatctgccttttttaccgaaggcggcttcgaacgccgcttggaattctggaagactccgcggctgccatcagaggaaatgatctggactttcggatcgcctatgacagcagggatgagatgggcaggctgtgccagtcctttgaagagatgcgccaggaactggtatgcaataaggaaaacatgtggaaactggtggatcggcagaaagagttgaatgcggcgtttgcccatgatcttcgaacgccgctgacggtattaaaaggatatacggattttttggccagatatatcccggagggcaaggtaagccaggaaaagatgcaggataccctggaattgatgtcggatcatattaagaggctggaacgctacagctataccatgaaagaagtcagaggaatcgacgaggtaccgctgcgggctgaggatatggcacttgaggggatacagagcaagataggagaagtggtatttgccttgaaccagatcggggatatctggatcgattatgccagatctgatacggaatgcgagatatacgcggatgacagcctgatcgtggaagtacttgagaatctgctttccaacgctattcgctatgccaggacaaagatccaggtaatggatgactatgatgcggccagcagcgagctgatcctggcagtcagagatgatgggccgggatttgccaaagaacagatgcgaaaggcgctcaggccttattataaagagtatgaagacgatgcaaaggatgaacacttcggcatagggctccatatctgcaggcagctgtgccgcaagcacggcggaacgctggacattgccaacagcgtggaaggcggtgccatcgccacagcatccttctcctgcaaaaaggaatcaagagaatcttaatatttcgtagggaaaatatagatatttgtattctatgctatagatatccgaatagaaagagaggagaatcagaatggatataagtatcaagatagaaggcctgaatcaatattatggcagaaaacaggcgcttaaggatgtgaatctttatatcaagacgggcatgttcggactgcttggaaggaatggggcgggaaagacgacccttatgaaggtcctggccacgcttcttaagaagtccgagggaaatgtatcaatatgtggcatcccggtagaggatgccagggaaatcagacggatcgtagggtatctgccccaggaattctccatgtatccgaatatgacggtatatgaggcgatggattatctgggcgtgctttccggcatggatcaaaaaagcagaaaacagaagattccaaaacttttatataaggtaaatctacaggaagaccagaagaaaaaagtaaaagcattatcagggggaatgaagagacggctggggatagcccaggctatcctgcatgatcccaagatactgatagtggatgagcctacggcgggactggaccctgaggagcgtgtcaggttccgcaatctgctgtgcgagatcgcaaaggatcggattgtgattctgtctacgcacatcgtgggggatatcgaggctacctgcgaggacatcgcggtgctggacgaggggagcctgatctaccagggaacggtggcagagttgaccagtctggcagaaggaaaggtatatatggcggaaatcagcaggaaagaactggaagcgttaaaggaaaaatacatggtgaccagcatgcttaccctggggaataatgtgatggcgcgttttatatctgaaaccaggccctttgagtcggcgaaactttgcgaggcaggggtggaggacgcctatctgtatctgatgcatgggaagcggggtggacgataatgctctttaagcttttcatgaaagaatgttcccaaacggtaaaaagcctgacttattggctgatggtgatcatcatggtactgtttttcgcctcccagatgggacagatggatatggagaaggcgccggaaaaaggcttggaggattatggcgtcaagccgagcaaggataagaatatcattatgagcgcaaccttgggaatgcttgccggcgaatacgccgaaggaagatacacgacctatcccattggatttgtcaagtcagtgacgcttggcaaggaagaagaggcgaaagtaggagagatattgaaagaagccacggggcttgacaaagaagagatagaagagaagatagatgaattctatgaaaacagcggcggcatcattacctccaggccagtgcttgagccattggaaagcctctcttacgggcggtttgaagagatcatgcaggaagtagatgacatgctgggaggcggatcatcctatgctttggattcgctaggagataacggctctgagcctaagacctatgaagatgcggtgaaagagtacgaagaactggtacaaaaggacggctataccggaggctatgcccgccttttcagcgactacatggtgatcattctgggaattcttccagtattcctggctgttaccagggaactgcgggatcgaagggcgaatatgcaggagttgatctatgtccgaaggtcctcttccatgacgatcatcgcaagcaggtacctgtctatggtcgtgatgatattgattccagtctttgcgttatctatacagcctttggcaggctgcgtcacctatgcaaaaacagccggaatatcggtggattacctggcatttgcaaagtatatcgcaggatggctgctgcccaccgtcatggtggtgacggcgcttggcatgctcttgacggaactgacggatactgcgcttgcagtgctggtacagggagcctggtggttcgtctccatctttatgggggcgaagacgatggacggaggaaggtatggatggaatctgattcccaggcataatacgattctgaattacagcggataccaggaggggttctcgcagctgctgtctaacagaatcttgtatgcatcgcttgcggtcatcgccgtatccgtgacagcctggatctattcgcagaaaaggaaagggaggatgaatattcgtggaaagatatctgcaaatcggaaaattcaatctaacgcataatgtcctgtggcatttgctggcctgcgccctgcttctgtgcgcctccccgctagtgctgggcaccagcaatctgggagaacgtgatactgcaaaggtactggaaatgttcgtggcgctcattggcatcattatgatcccgtcggtgtttctgccggagcagaaccgggacatccgggaattgatccgttccaagtatacgggctgtggaatcgtgtatggcatccggctaatgacaagcgtgctgattcttgcagcgcttctggggatatacgtctggatccttgccaggggaaattgcagtttcccggttgccggctattattgcggtactctggcggaaatgctgttccttggcggattagggttgttcttttacggactttctgataatcttgtgataggatatatgatcccgtttttctattacatcgttgcgataggaagcggagataaatacttaagaatgttctatccattttccatgcagaaaggcagttatgacgagaaatactatctgctggccggtgccatcatcatgatcggcgcaggagtatgcctgaggtgccggaagcgctagtgccggcgcatggagataatgagatagagcgggacaatataaggataccggaataaccggcaggaggatgagcagatggaacagaagaccgtgaatctatatacccgtcagaatgataagaccctgtatcagctggagcgaaatggcaggattatcaatgaaaggatctatgtagaactgcattttggagatatcgcccccttatttatggaaagttacgactggtttaccagggaggcggctaagaaagtggcaaagcctgaggatgtaaaggccccgatctggtgctcgataagcccggataactgcttaaagccgattccggataccgtggtctatgtgctggaagtgccccaggatcagatcatttactttgatgatgtgaagtgggattatgtactgaaccgtatctatcttccgaaggatgacgaagatgccgccgcttataagcggcacctgaaagagatcggggtagagaatggatttgaattctttgagggcagatacaagggcatgttcccggaggaagtagagcgcatccgcgccagctggaagcgggtctttgagatcgacaactggaccatatttaacgtctgcggcaatatctgggagattaagaaggaatgggtaaaacgtatcgtgcggcccggggagagcgtggactagtccacgctagatggaacgcaggtttggcgcgtatttcccggccccatccttctggcggacgcgcagagtacgaggcagcctaagagaagagactgcatttgtaaaagtagtcagctgcgggatggaaaaagcagcggtcataagcaggcaggacaggatcagcagaagagagccgcttagcgtatcgatcccccttagcaggtccgtgcagcctttcagataggagtaggccaggccatggaacagatagatcgccatggtccgggttccgatataggaatagaatgtccggcggccagacatcagcaatgccaccgccagcgtcatggcaaagccgatgccatagcagattacccggcagatgacgccttcgataatactctgatccagataatcatagttatatcttccatagaagattttgggagaaagattcctatggaaagggtcaaaagccagaaagcatgcaaaggcagcaacgcctgcgcatgcgatcatccggtttttcagagtgcgcattcttacaagcaggcttcggtcaaatgccgaccctgccaggaagtaagggaaaaataccagggtacgcggaatgcttaagaaattgtccggcatatcaaggcatccggccagaagtcctgcgagaatggaaatggccatataatgcggaatctttcggatatgcggagccagcagccgccagaaaaacagcgcctggatataccacagggagaatttggggtatagcaggtacagcccggttggcttatggatgatgaaggtgtaaacaagataataaatgatttcatatataaaataaggtatggcaagcttctggaacaagatgccaagcgaaagcgtccgttttgaaaaatagccggatatgaagataaaggccggcatatggaaagacactaccagccatttcaaagcgtacaggaactcgttatccttgtagctgagttcaataaagtgtccgattactaccagcgcgatcagaagcgccttataattatcaaatagatagtcccgcttttttgtatttcccgacggcataatttcaactcctatgatcaaattctatttttagcctaatacattctactcctggattcttatcaggacaagaagtaaaatgtataaaaaaattaatgatattttcatgaatttgtaacatttttatattagtggataaaagaggggaactaggtttataatacagatataaggcactcgtagacgaagcggcagatagtcatattgcagtttcagccatattctggaaggtgattgtatgggagattttattgtttttattacgccgtttattattgccctgaatggcatcttgctgatcgcgaccgaagtgatagactggaagaataagaaaaagcgacgggaaggcgctggcggggaagcagataaaaggcaggaagagtatgaagagataaaaagaaaatggagggatggctcctaaaggcataaaaaaacggttccgatcaggaaccgtttttttatgcccgattctattccggagtgggaagaatcagaagagacaagttggtcagatccgcattgtcctccccggcggagatcagggaattgaaattcaccggcacattcaccgtagtctcttccccataagtaggcgctgcggcgtatttttccaaggttgctaccaggcctgccgatacctcgtcaatcgaatagtaagtaccctgctgaaattcattcattgcatcaatcaagctgttatttggcacgacagtgacatccatagtgtagttgaagcctccggcatcctttttgggaatccctgtggagtactggcactgcttcataatattcttaagggcatccttatatctctgcacataggcctcgcctaactctgaaggaggatcgaacgtctccgtctcataccaggcaagagcctcttcctcggtgcggctggtatgtttggcaaattgagttacctctcccttaaaactggcatccagataagattgcaaaaagttctggatgtccaggatctcgcagactgcattgtatggctccatgcagtcgtacaaagcctgggaaagaaatgctttcaggctgtcgtcgcttatggcgaaggaatccccatccttcttaacctccaaagtcgagatgacttcggcctggtactttggcttatcggcaagtattttcgcgtctgcttcaaggagggcggaggtctccgcagccagatcagatgattttaaggcgttggccttctcgctgtcagaagactttaaggtctctcccacattgagcggggtataggtgacgtcaactttatagtttccgtcatctccttttttggcggaggctacttcaaactctatggtcttgaagcattcctgcaggaacttctggtagggctcctttaattcttccggaaactgtagtacatactcctgattgcttttggcgattccatcatccagaacggcggcgaagcaatccgccttttcctttttcatagaagtaatctcctcgccgacgtatttatcggcggagtccttgccgcatccggccaggcatagcatggacagcaggaaggcggcagataggatgattttctttttcataacgctaaccctcattcctttcttatataaaattatgataactgtatttattgtaacatcaagaaacagccgcttcaacaggaggttcaagaagtttcaaataccactggaaaaacctatgtattttatatataataagataacaggtcaaaaccaatgaaaaaggagatgtattcatggaaaggttatcaattgagaaagaactgcagggaaattcatatccgggacgcgggattatcataggcaggagcgctgacgggaccaaggccgtaaccgcttattttattatgggaagaagcgttaacagccgcaaccgaatctttgtggaggatggggaaggcatccgcacgcaggcatttgatccgtcaaaactgactgatccgagcctgatcatctatgcgccggtgcgcgtgcttggcaataagacaattgtaacaaatggagaccagacggataccatctatgagggaatggacaagcagatgacgtttgaacagtccttaagaagcagggagtttgagccggacggccccaactatacgccaaggatttcgggaatcatgcatatcgagaatggcacatacaactatgcgatgtccatcttaaagagcaataatggcagtccggacagctgtaaccgctatacgttcgcttatgagaacccggcagcaggcgaagggcattttatccatacatacaagtgcgacggcgacccgctgccaagttttgagggtgagccgaaactgatcgcggttccggatgatatagatgcatttacagatacattgtggagcagtctgaatgaagacaataaggtgtctctgttcgtccgctacattgatatcgcttctggtacatgtgcgaccaggattgtaaataagaaccagtaagtcaaaaggcaaggataataaatacaaaggagcaagagaagatgaaagaattagagttgaaatatggctgcaatccaaatcagaagccatccaggatctatatggcaggcggcggggaacttcccatccaggtattatgcggaaggccgggatatattaacttcctggacgcgtttaatgggtggcagctggtaagcgagcttaagaaagccacgggacttccggcagcaacctccttcaagcatgtatccccggcgggtgcggccgtaggactgccgcttagcgatacgctggcaaagatctactgggtggatgatctgggagaattgtccccgcttgcctgtgcatatgcaagagcaaggggagcagaccgcatgtcttcattcggagatttcatctccttatccgatgtgtgcgatgtggacacggccaggctgatcaagcgcgaggtatccgatggcgtcattgcgccaggatatgagccggaggctctcgaacttctgaagcagaaaaagaatggcaattacaatgtcatccagattgatccggattatgcgccggagccgctggagcacaaggatgtgtttggcatcacgttcgagcaggggagaaatgaactgaagatcgatgatgaattcttctccaatattgtgacggataacaaggaactgacagagcaggctaagattgatcttgccatctctatgatcacattaaaatacacccagtccaattcggtatgcttcgtaaaagacggacaggcgatcggcatcggcgcagggcagcagtccagaatccactgcacgcgcctggcaggtaccaaggctgacaactggtggctgagacagtccccacaggttatgaaccttccattcgtggattccattcgccgtgctgaccgggataatgcgattgatctttatatcggtgacgattatatggatgtcctggcagatgacgcatggccggcaatcttcaaagagaagccggaagtattctctagggaagcaaagagagaatggcttgacaagatgacggatgtggcccttggctcagacgcattcttcccatttggcgacaacattgatcgcgcgcataagagcggcgtaaagtatgtcgcgcagccgggcggctctgtaagagacgacaatgtgatcgcaacttgtaataagtatggaatggtgatgtcctttacgggaatccggctgttccatcattaagaatttgtaacttcaaatgcagtcaaaataaggaaaccgtgcctattcggcaggaaatctggatgatttcccgtctcagagacacttggggattttgcttgtggcaaaatccccattccttattttggctgcattttcagtaacaactcctacggctcatccgacggaaaggtaaagccccctccctcgcgtacgccaatttcactacaaatcccccaaaatgtagtattctttaaacgtttgtccttctttgtacattcaattttctgacaatttcccttacaatagtttttaaaggaaggtgatgcagatgtccatagcagagattctggttatctccatcggcctatccattgatgtatttgtggcggtggcatatcttggggcgggcttttctaagatccgtgcgagaaatttggccggacttagccttttatttggcgggatgcagcttggaggcctgattatcggcaatctggtcactttgcttccggcagttccgacagaccactcgaagaaagtggctgatggctgggaaggaataacggtactaatctttgcaggacttggaatctatatgatatgcaagggcgtgaaaagggaacaggtcctggaacgccggaaagacgcgatcgaatggaagacgacgacggccctggctctggtgaccagcatagatgcatttatggcaggcgtagggatgggatttttggatacggaggtgattgcccaggcgatcacactatttccggtgacagtcctgcaggttattttgggcgtatatgcagggtacaggcttggcctgaagcacaacaggcatgcatactggattggaggagcaatgcttcttttggccagcgcggacgtagtaatccactattatatatagattgaacgaaagaagaaggaggaagcgtattatgagcacattatcacacaaagcggcaagaggcgcgtatggaaccgcgatcgacatggtcttaaggcacatgaataaggacagggaaaaaggaatgcttcaactggtggatctgacagaacgctatatgggcagccattttgacagcaagaattatgaggctgccaggcgtatgataaaggatcctgagagtaaatggatgaagtatatcaaccgtctgctggacgaggtagatccctacgtcatccgccagtcagccctgaatcttggctatgaagcaggactttatggcaccaagaccatacgggagatgagaaaaaagtatgactgcaatatcccatggctgattctgatggaccccaccagcgcctgcaacctgcattgcaccggatgctgggcagcagaatatggcaacaggctgaatctcacattcgatgaattggatgggatcattacccagggcaaagaactggggatctatttctatatgtataccggcggagagccgctggtacgtaaagccgatattataaaactatgtgagaagcataatgactgtgccttccacgcatttaccaatgggacgctggtagacgaggcgttttgcgaggatatgagaagagtggggaatctttccttgtctatcagcctggaaggctttgaagaagtcaatgattttcgtagagggaacggggtatttgacaaggtaatgcatgccatggatctgctaaagcagtccggacagatattcgggacatccatctgctatacgagcaagaatattgatacggtgacttcggatgaattcctggatctgattatagaaaaaggctgccggtttacctggtatttccattatatgccggtgggaaacgatgcggcgccggaacttcttccaacgaaggagcagagagagtacatgtaccacaggatacgggaaatccgggcaatggaaggtggcaagccaatctatgccatggacttccagaatgatggagagtttgtaggcggctgcattgcaggcggacggaactattgccatatcaatcccaacggcgatgtggagccgtgcgtattcatccattattccagcgcgaatatcagggaagtctctctgctggatgcgctcaggcagcccttgtttatggcatacagggataatcagccattcaacggcaatcatttgcggccatgcccgatgcttgagaatcccgagatccttatgcgtatggtaaaggagacaggcgcaaagtctacggaccttaagtcccctgagacggtggagcatctgtgcggcaaatgtcatgagtatgccgaaaactggaaggaaactgccgagaagatatgggaagagaatcctcatcataagatgaattatgaaaattacaagcagagccataagtcggcaagctgacctttcttatatcataggaagttctgttccctatgatacaaaatcctccgcgagaatgtgcagagcacattctttgctctgctaggaaagaaggaatccccttgaagaaaaataactggtggaaaatcatattcattgtaatagtcctcatcatcctctgtctgttatttggagattccttctcttctatacaaaaggaaatatcggatacggcaggtcagacgttgcttggaatctgcctttgcggcgtattctataacctttcggagggactggtatacgtctggcttgccagaaggcatcagaatgattttcattatagggacggcatcgcctgctcgtactatactgcgttttaccgtacggttacccttggaagcgggacggcggcagcgacagtatattttttatttaagaaagggattcaggtgccggaaggggttgccatctgtgcagtccaatatgtattgcagaggattgcggtggctgtgtttggagggctgggctttttcttctgcggcgcctatatgaaccgctggtttggggaataccgcatggaactgattctgggctatggcctgactgccgtcatctgtctgatcctgatactggcctgcgtatccggacggttccaccgtacgctggcatggctgggaagaaaagcagacagaaagcacaaatatgaaaataagattatgcagatggaaggcaaaggcatgcttctaaggcaggagacggtgaaccttataaaagacaggagggatataatcctggtactgctgatggaactggcaaaactgggctgctggtacgtgattccgtatatgatcctgcaccctgcgggttcggggatttttgagacggcctgcgtcacttcgctaatattgatgctggcaggcattattcccgcgcctggcgggcttggcagcacggaaggggtgttcatcctgctgttttccaggatcgcaggaggcgtcgaggcggcttccgccatgctgctctaccggttcgcgacctatatggttccttgtgcgcttggcggcatctgtgttataatattccataaatactggaaggcaaatggtgacaaagggtgattgaatggaacgtagaagcgaaaagacaaaggctttgctgggcgaggaatttaaagaactggtggtggaaaagtcttttgaaaaaataacaattaagatgattacggatgcggcaggggtcatccgtccgactttttataattattttcaagataaatacgaggttatggaatggctgttatgggaagacgtctttcaaagcgtgacggagcttatttccatggatatggcgctggaagcaatgaagatgctgtttcgcaagattggagcggataaggcgtattatagaaaggtttttgaagtagaaggacagaattcttttgaagagatgctgtatcagagaatctacgacgtggctcggcaactgatcgaaaagcatcctctgaaagtggaagaggacgcgcccatcatcagcgaggagatattcttaagattccagtctatcactttggtcaatgggatcaaatactggctgctgtatgaaacggatgagatatccgcggatacggcgcttaagttttatgaatttctgatgtcccattctctgttggagattatcgatgatgatatattaggcagggttattaattaggatcataatttctaattaatgccttgtttttttatgtcccaaatggtatgatagtcgaggtgtaaaaagccctgaaacaataggaaagagaagtgatagcatgaatcagtatgacgtgattattataggtgcgggtccctccgggattttctgcgcatatgaattgatgagacaaaaaccggatctgaaggttttaatgattgaaaaaggtcgttcgattgaaaagagacagtgcccgaagagaaagaccaagacttgcgtgggctgccagccctgctcgattactacaggatttgccggagccggagcattttcggatgggaaattatccctctccccggatgtgggaggaacgcttccggagattctgggatatgagagggcaacagaactgatccacgaggcagacgacatctatctgaagttcggagcagatcagaaagtctatggcatcgaggattatgaggccatcgagaatatccgcgccaaggcgatccgcgcgaacctgaagctgattgaatgtccaatccgccatcttggaaccgaggaaggatataagatctataccaggctgcaggagcatctaaaatcctgcggcgttgagatcaggttcatgaccatggtcaaggatattatcgtggaagacggcgctgccacaggagtcgtgacggataagggcgaggaattctatgcgccggagattgtggcaggaatcggaagagaaggctctgagtggttctcccatatctgcaaggagcatgagatcgagacgcgcaatggcacggtggatgtaggcgtacgcgtggaagtccgggatgagatcatgaaggaacttaatgagaagctttacgaggcgaagctggtatattatacgccgacgtttgatgataaagtccgcgtgttctgcaccaacccctcaggggaagtggcaacggagtattacgatgacggcctggcggtggtaaatggccatgcatataaatccaaggatatgaagacgaataataccaattttgcgctgctggtttccaagaattttacggagccgttcaaatcacccattgaatacggcaagcagatcgcgcagcttggaaatatgctgtgcgatggcaagatacttctgcagcgctacggggatttccgtcggggcaggcgtactaccgaggaacggctgaaccgtaacaacatcgtgccgacgctgaaagacgcggttccgggagatctgtcgctggtattcccgcaccggatcatggtagccatcgatgagatgatccaggcgcttgacaaagtgaccccgggcatcgcttccgatgagacgcttttgtacggcgtggaagtgaagttctattccaataaagtggtcgtgaatcaggattttgagaccagcgtaaaaggccttcgggcaatgggcgacggcgcttccatcaccagagggcttcaacaggcatccgccaatggcataagtgtcgcaagaagcatattagcaaagtagagacaggtaagaatataaaaggggacgtaatgcttttgacaatgttacggccccttttgacgttatttttttacatttgggttgtatataaagtaaaaaaaatatataatagtaaaggtgtgaatgctgatagtgcaaaaaaatcggtaaatatggcaaatgatttgaaggagaagtattgctatgggaaaatattttggaacagatggattccgcggggaagccaatgaggtattgacggttgaacatgcattcaaagtgggaaggtttcttggatggtactacggccaggatcataaggccaaggtcgtgatcggaaaggataccagaagaagcagctacatgttcgagtatgcgctggttgcgggacttacggcatccggagcaaatgcgtatctgctccacgttacgacgacgccaagcgtatcctatgtgacaaggacggagaattttgactgtggaatcatgatttctgccagccacaatcctttctatgataatgggatcaaggtgatcaacggaaaaggacataagctggaggctgaagtagaagaaaagatagaacgctatatagatggcgagatgggcgagctgccgcttgccaagaaggaggagattggccgtaccgtagactatgcggcaggaagaaatcgttacataggctatctgatttccctggctacccggtcatttgaggataagaaggtgggcctggactgttccaacggaagcgcgtttgccattgcaaagagcgtttacgatgcattgggggcaaagacttttgtgatcaactgcgagccggatggcaccaatatcaatacgaactgcggctccacccatatcgaggtgctgagggagtatgtaaaggagaatcatctggatgtgggattcgcctttgatggagacgcggaccgctgcatcgcggtggatgagaacggcaatgtgatagacggagatttgatcttatatgtctgtggcaagtatatgaaggagaacggacgtctcaacggagataccattgtcactacgatcatgtccaacctggggttatacaaagcctgtgacaaggtaggcctgaaatatgagaagactgcggtgggcgataagtacgtctatgaaaatatggttcagaataacttctctcttggaggggaacagtctggacatatcattttcagcaagcatgcaaccacgggagacggcatcctcacctcccttatgatcatggaagtcatgctggagaagaagttaagcctctccaagcttgccgaggatgtgaagatctatccgcaattgcttcagaacgtgcgggtggcagataagaagacggcacgggagaatccagaggtcatgaaagcagttgacgcagtggcagaggcactgggagatgacggacgcatcctggtaagggagagcggaaccgagccggtgatccgggtaatggtagaagcggccacggatgaactttgcgccaaatatgtgggccaggtcgtcgatgtgatcaaatcgcaaggccttgttgctgagtaggatatgaaagcataaaaagtgaacaaataagtgaacaaataagggttccgctctagatagagtggaacccttttcctatgatctcgctggtattggagataagaaggaacgcgtccggcgcattttccttaataaaattcctgagtttgacggcctcgatccgattgagcgccgtaaagatgatatatttgtcctcgccggagaacgcgccttgggccaggacaatggtggcgcttcgatgcaagtcatccttgataaagtcgcagatcggcttgggacttgtgcacactacgttaaaatacttggatagattcaaactttcaataaagccgtcaatcataaaggagcggacggctagtcccagaaaagaataaagcccggtctcgatatcgaatacgaagcagcctgcaagggtaataataaagtcagtgatcaaaagcgcctttccaatatccgtgctggtatattttttcatgatcatggcaatgatatccgttcccccgctggacgcgccgatattaaagagcacggcagagccaagggaaggaagcgcgatggcaaaagccagttccagcaccggctgatcggtaagcggctggttcagtggatacagccgttccaatacggataaggtgacagacaaaaggatgctgcagtaggctgtcttttccgcaaatttcttgccaaggaccacaaagccgatggcaagaagcaccatgttggcaatgaacgtaaagtcgctggcggagattcggcctgtcttcgctaccaggaccgcaagtcctgtgattccgccaaatgtaaagttgttggcgaatttaaagaagtagatgcctactgccattattatggtactgaaggttaataagaagaaactttttaatttcgttttcataattccctcctttgtctgcattgtaaatctgccgtgtagaaatgtcaacggattcatgctatattggaagaagaataatgtaagcaaggagatgcgaagagatgaaaatatttcagcagaaatcaagaattcagaagtttgaagatgtacggcagtttgtggaagagtatcagttaggaaaggatgatttcattctggcgagcaaaagcatttacgaacggtattttgcgccgctttcgctggaggcgcatgtagtgtacaaaagccagtatggaaaaggcgaacccacggatgccatggtagacgggctgatggaagatttcgcgaagacacagtgtaagaggattgtagccatcggaggcggcgcggtcatcgatatggcaaagatcctggtgcttgaggggacatataagacggaagatatttttcttaggaaagtgccgcttaagaaggcgcgcccgctgatcgcggttccaactacctgcggcgctggatcagaggtatccaatgtatccattgcggaactgacgaatctacataccaagcttgggctggcagtggatgagatctatgcggatgaggcagtgctgatcccggaacttttgcgggaacttccatactcgttctttgccacaagcgcgattgacgctttcatccatgcgatagagtcttacgtttctccgaaggcgaatctgtatacggagatgttcagcatgaaggccatggagatgatcgtgggaggctttcgcaagatggccgaacacgggaaggaataccgcatggaactgctggatgatttcctgacggccagcaacctggcgggaatcgcatttgggaatgcgggtactggcgcggtccacgctatgtcctatccgctgagcggcgtctaccatgtgacgcatggggaggccaattatcagttcctggtggccgtgttcgagacctatcagcagttgaatccggatgggaagatcaggcagttaaaccatttccttggaggcctgcttggctgcgatgagagcctggcataccaggaactggaaaaattattgaatgtgatcatcgcccgcaggcagctccgtgaatatggaatgaaagaaggagagatagaagaattcgcgaaaagcgtggaaaagagccagaccaggcttctgaaccagagttatgtcaagttttcctggcagcagatggcagaaatatacagaaggctatattagtccattattgcattagaaaaacattaattacacataatatcctccatgaaggaggagataagcgatgtataagtatttaccgattacggatgtatacgcaagagaaatcttagattcccgcgggaatccgactatagaagtggaagtgctggcaggggacgaatacctggggagggccagcgtgccgtccggcgcctctaccggacagtatgaggcagtagaactcagggataaggaagagcggtatggcggccttggagtggagagggcggtagaccatgtgaatgccaagatcgcaccggcagtgatcggcgtgaacgtatttgaacagccggcccttgacgccatcctgctgcagctggatggtacccagaataagtctcatctcggtgccaatgccatgctgggagtgtctatggcagcggccagggcggcggcaggcgcgctgcatatgccgctgtatgcttatctgggcggtaccaatgccaagaagatgccggtgccaatgatgaacatcatgaatggcggcaagcatgcggataataccattgatatccaggaattcatgatcatgcccactggcgcctgctgcttcaaggaaggccttagaatgtgtgcagagatataccacgtgttgaagaaactcttaaaagaccagggatacgccacagcggtgggagatgagggcggattcgcgccgaatcttccggatgccaaggaagccctgcgattcatcacggaagccatcacaaaggccggatataagccgggagaagacatcgtcattgcgctggacgtagcagccacggaattatacgacaagagtttcaagaaatacgtgtttgaaggcgaaggcaggatgcacggccataaagttatccgatcagtggaagaactgatcgattattatgaagaacttgcggaagaattcccgattgcctccatcgaagatcctttggatgaagaggactgggaaggatgggaactactgaccaccaggatgggcttggatacgcagctggtgggggatgacctgtttgtcaccaacaccagaaggcttaagaagggaattgaacgggaagtggccaatgccatcctgatcaaggtcaatcagattggaacgctcacagaagccttcgatgcgattgagatggctcagaaggcaggctacaaaacgatcatatcccaccgttccggcgagaccgctgatcctatcatagcggatatcgcggtcgcgtttaatgccggacagatcaagaccggggctccgtgccgttcggagcgggtgtccaaatacaaccagctgctcaggattgaagagcgtctgggagatatcgcagtatatgaagatccttttggaactttggatgcgctgtaagattttcagctttcttttagaaatctaaagaaatattttgtttatcataaagagaatcttaagatttaaggcgtaagatgagaaccaggaggtggtaatatgcatacgatttcggttatcataccatgttttaatgaagaagaggcgctgccggtctattatgaagccatgaccaaggttatggagcagatggatatggcagaattcgaattgctatttgtagatgacggttctaccgaccgcacgcttggaatattaaagagtttgaatgaaagggatgaacggtgcaggtatctgtccttttccagaaattttggaaaagaggcggctatctatgccggccttggcaatgcgaagggggactatgtggccatcatggatgtggacttgcaggaccctccgtcgctgctgcccaagatgtacgggattctggaaaatgaagaatatgacagtgtggcaaccaagcgttccactcggacaggagagccaaagatccggtctttcctgtccgaaagtttttataagtttatcaaccggatctccaagacggagattgtaaatggcgcgcgggattatcggctgatgaagcgcaagatggtggatgcggtgttggaaatgagcgagtacaaccgtttttcgaaaggcatcttccaatgggtaggatttcgtaccaagtggctggaatatgagaatgtcgaacgggcggcaggggagactaaatggtccgtgcgcaagttgttcctgtattcgctggaaggaattaccgggttctcggtggcgccgctctccctggcctcgattgcgggagtgctgttctgcctgatatcatttttgatgatcgtagtaatagttgtccggacgctgatctggggagaccctgtatcaggctggccgtccttggtgtgcattatttttatggtgggcggcatccagttattctgcacaggcatcgtagggcagtatctgtccaagacgtatctggagacgaagcgccgcccaatattcattttaaaggattccagcgatgacaaggacggaggggagttatgatccgctccaggctgaaatggtacgtgctgttcgcgggaatctcgctgcttctgtgctggctgttcgtagggcagtatgggattttcggctcaaaagtagactggatcagccagcacagcgtaataccggactatttccgtcagcagttttatgagactgggagtctgttcccggaatttgccatgaaccttggcggaggccagaacatatactatttcgcttattatgggctatataatccggtcattctattatcctatgcacttccttttgtgaagatgggcgattatgtgatggcagccagcattatcagcctgatagcggcagtctgccttctctatgaatggctggataaaagaggatttcaaaaaagcgtctgtgttacggtatcgatgctgtatctgcttgcttcccctatgatatttcattcttacagccaggtaatgttcgtcagttatatgccctttttatgcatggcattcctgggagttgatgcttattttgagaagaaaagatgcgggctttatattgcaggagtattcctgatgattatgaacagtttctactttagcatcgggggaatgctctctctggcaatctatgggatgcatagatattttgagacaaagaaatttggattacggacgttccttacggacggcatccggttcctcatgccgatgctgtcagccgtgcttctgggcggcctccttttggttccggcggcgatggcccttggcggaggcaggggaggaaaggaaagcatgagtctggcgtccctgctgataccgcaggctccgatattccgtttcgtatatacgccttatggcatgggccttacaaccattgccataaccatgctgataaccagcctgacctataggaaaaccagcgagcgagtgctctcttatggatgcgccctggtgtttgccataccaatgttcgcgtatctgctgaacggaggcctgtatatacgggacaaagtattcattccgtttcttccgctgatctgctatatgatggctgtctacctgaagaaacttggaaatagagagatttcttttctcaaagggatggctccttacctgatcacaatcctgcttttatatctgggaagaggacaggaagaatacgatggatactggcagtttgtcatggcggatggaatacttatggcggtcctgttcgctttctattattacaaggacaggaggctgccgccagtattaatcctgataccgtcgcttgcgttcctgatcctgtttaacggagtatttcataagatatccaggcagattgaagatggggatttctatcagaaggttacggattctaagattgcccgggagatcgaggagattcaaaaggatgatccgggcttttaccggattgagcaggcgggggatgaagaggagaatgcggcggaccttaaccggatccaaagtatggggcagaacatttcctccatctattcttcggcatataacgccgcttatgatgaattccgtaagaagacgtatcaggtggagcagccttataggaacagcctgatgcagtctgtttcccggaatccgctataccgttcctttatgggcgtcagatatgtaatcggggatcaggcgccgttaggatatgaactggcgaagtcatcggaaggagtgaagatttaccggaacaccaaggtctcgcctgttgcctatgctacgaatcgctatatatccagaaaggagtatgataagctggcatttccttataaccagacggcgcttgcagaatatgcagtggtggaacaaggcataggagagcaggaagccagggaggcgggacagatggcagaaggggccaatgagaaagaatttgccataccggaactgaaaagagaatacctaaagattaagaaaaatgccagcggctaccacatagaggcggatcaggcagccacgataaaggttcccatatccgggctggaagagggagacaacatcctctttctccaattcaaagtcaacaatggccgacccaataaggacgtggcgatctggctggaaggcgtaaggaataagttgtcttccagagagcatgtctactataatggaaatacgacctttacctacacggtagaactggcccaagggcagcaggaagcctctttgaaattaggaaaaggggactacgatatctcagatatttcctgctatggaacaagttgggatgaaggggccggggagactctgtatcagtctgtgttcgaggctgacaagaaacagacgaaagggaatcagattgcgggaacgatccaggtgaaggaagagggatatttcatcactacgattccatatgacaagaacttcgatattacggtggacgggaagaagaccagggccaggaaggtcaatacagcatttcttggatttcccataagcgaaggacgccatcaggttgagattgtctatcatgccccaggcgctggctttggaaaactcctgtcccttttgggggctttcatggcagcagccctggtgatcgcatccagaaaaaggagcgcccagggcatccagaatcttccttaaatagcctagattttccttgctatatcttgtctcctgtgctagaataaatatggtttatccgcaggaggtgtaaaaagtggagatattaaagacgattttaatgatcatatttgcaatagactgcatcgcgttaacggcaatcgtgttaatgcaggaaggtaagtcagcggggcttggtaccatcagcggtatggctgatacttactgggggcagaacaaaggccgttctatggagggcgcgctggtgaagtcaacgaagttcctggcgattctgtttattgtactggcagcagtgttgaatttaaaagtatttgcataagataaagcatatttttatgagaatggtgggacactcctgtatgggagtgtctctttgtgtataagatggaggacttgtaagagatggacaagacaattgaaaaaagaaaaaaggtcatctatgacttgatctgtgatgatttatacgtgccaatgaagttcaaagaacttgccatgcttctgcaggttccaaaagatcagaggaatgaactcagggagatccttgaggcgctggaggcagagggcaagatctatctttcgcagaaaggaaagtacttaaaaggcgaggctaagaggattcaaggcgtttatcgcgccagcctgaaagggtttggattcgttacggttcccggcgaggcttcggatatattcgtggcggaagaagatgcgggcggagcttttgaaggcgaccaggtagaactcgtcataacaaaggagcctcagggcagaagccgggaaggcaagatcgtaagaatcctatcgagaggaatcacccatctggttggactgtatcaggggaacccgaataagagttttggattcgtcaagcctgataaccagaagtttccgcatgatatctttgtgccagtggaaaaggccaatggcgctgtgcaagggcataaagtcgtggtggaattgacttcctacggcggaccgcaaaagaagcctgaggggaaagtagtagaaatcatcggacatatcaatgatcctggcacagacatcctgtcgatcgtgaagggatatgatctgccggtggaattctcggaaaagatattaaaccaggcgcagcgtgcggccagagacgtatccgatgccgacagggcagggagaaaggatatccgggactggcagatggtgacgatcgacggagaggatgccaaggatctggatgacgcagtatccgtggttaagaatggggagaactatatcctgggggttcatatcgcagatgtgaccaactatgtccaggagaacagcgcaatcgaccgggaggcgcttgagcggggcaccagcgtgtatctggtagaccgggtaatcccgatgctgccccatgccctttccaatggcatctgctctttgaacgcaggagaggacaggctggccctcagttgcatcatgacggtaaatcccaagggcatggtgacagcccatgagatagcggagaccgtcattcatgtggacgaaagaatgagttatacaagcgtcaagaagattctcgaagaccgggacgcaaacgagataacaaggtatgagaaactggtgcctatgtttgaacagatgcaggaactttctggcatcctgcgggaacagaggaaaaggcggggatcgattgatttcgacttcccggagacgaagatggtgctggatgagaatggaaagccggtagaaatccgtccatacgagcgtaatgtagcaaccaagatgattgaggatttcatgcttcttgccaacgagacggtggcggaagattatttctggcaggaacttcctttcgtttaccgtacccatgagacgccggatgatgataagatccgcacgctggcgacatttatcaataattttggatattccatgcatgtgggagccaacgaagtaaagcctaaggaagtgcagaaactgctgggcaaggtggaggggactccagaggaggccctgatcagcagactggcgcttcgttccatgaaacaggccagatatacgccggagaataccgggcattttggccttgctgctaattattatacgcatttcacctcgccgatcaggcgttatccggatcttcagatccaccggatcatcaaggataatctgcgggggcggatggacgcaaagagaatagagcattaccaagggatactcccggaagtgaccaagcactccagcgagatggagcgcagggcagacgaggccgagcgtgaaaccatcaagcttaaaaaggtagagtatatgcaggcgcatatcggagaagtgtttgaaggcgtgatatccagcattacaaaatggggaatgtatgtagaactccctaatacggtcgaaggcctggttcatgtcatcaacatggtggatgaccattacgagtatcagcaggaacggtacgagatggtgggaacccgcaggcataaggtatataagctgggccagaagatatccgtccgcgtaatggatgcggacaggcttcttaggaccattgattttgagattgcagatgaaggagagttggaagatggcgaagacgaatggtaagatgatagccaataataagaaggcataccatgattatttcattctggagaactatgaggccggcattgccctgcatgggactgaagtaaagtccctccgcatgggcaaatgcagcatcaaagaagcatttatccgcgttgagaatggcgaggtatatatctatggaatgcatatcagcccttatgaaaagggaaatatattcaataaagatcctttgcgggtacgcaagcttctcttacataagtcggagatcaataaacttcttggcaagactaaggagaagggtattgcaattgtgcctcttaaggtgtactttaaaggaagcctggtaaaagtcgagatcgggcttgcaaaaggcaagaaattatatgacaagagacaagatattgccaggaaggaccagcaaagggaagcgcagagagacttcaaggtccggaatctgggttaggaggaagaagatggtaccaagaagcaaggaagaattaagaaatatggtttctcagacgacaatagagacttacgaagaactgactccccagctgatacaattgatcgaccagaccaagcatgatgaatcattgacggaggcccagaagcaggacgagatatccctgcacatgatgggatatataaagtcatgcaccaatgaaatcataatcgaagttcttgctgagatattgggattggaagattcacaataaatatactagaagaaaaaggagaaatagaaatggcttattgtgtaaaatgtggagcgaaagtgaacgacggtgtgcaatactgcccgcagtgcggcgcaaagattccggtgatgccgggggcaggccagcagcaggacagccagcaaggctatacataccagcagaacggccagcaggattatacataccagcagaatagccagcagggctatacataccagcagaacaatcagcaaggttattcgggccagcagcagaacggaagggcaggagaattcttccagcaggacgatgtaagccagaataaggtaatgggggtcttgtcatatctagggattctggtattcgtaccacttattgcgggaaacaagcagtctccctatgtaaagttccataccaatcaagggctggtgctttttatagcatccatactcgtagatctgctggacggcagatggctctggggcttccattctatgattaattttggaggcagctggttctcatggatctttgatatctgcagcctggtgctgtttgtgtttatgatcgtcgggatcgtgtatgcatgcaaaggggaaagaaaagaattgccggtgatcggccagataaaaatattaaagaattaaggcttgaaaatcaaggcagccgccatcaatcagatgatgcgcggctgcctttttatattaatattcaggatgtttatatgaaaaaggggaaattcccctgagagcgtgggaccaggtccctctatattaaaagttattcaatcgtaattaattttggctgctcttcctgcttctgaatctcttttgggaactgaagcctgaggattccatctttaaatgctgctttaatgtcctcctgagtcagggcatcgcctacatagaaacttctgttgcaagttccggtatagcgttccttgtggatgcagttacctttggcatccttttcttccttggactcgctcttattagcggtgattgtaagataaccgtcctttaagtctgccttgatgtcttctttggcatatcccggaagttccatttcaataatgtaattgccgtccttgtcatgaatgtccgtcttcataatctgtgaagatgagttgtcgtatggacgggtaaagaatggatccttgaacatatcatcgaataaattgttaaaacctctgtttgcaagtaacataagtcattcctccttgatttatctttatttttgatttgttttatttgttatagttattatataacacaaattattagcactgtcaataggtgagtgctaataattttaaaattattagacaggcgcacctctcttagatattctataaatttatattattcatcctgtattcctttaattaaaaatagcatatgtcgttttgacatatgcctttaatctgtacattttattgctatcaataaaatggaatttgtaggttacgtaaattcaacgattactacttcgttttcgtcaggatcctttaagcggacttcataggttccccaatcatatctaatgggatcagatagcgtaactcctttttcttttaagcataccatcgtggaatcgagattttctgcttgaaaaacaaatgattgatatccagttggcggcgcattaaatgctttacaatcccatatacaaagagtgggcgcgttttctataaagccaagataaaccccatttgtactgtccacatcagtcctgataaaaggtatttctaatatatccctatagaattcaataagttcttgtgcctgctcagaaaaaatatttgtacaatagtatcccgttatcatcttctcacctcttcaaattaacctcaacagtttctttctcttttatctattaactatattctagcataagtataatgtatagtcatttctttccatgtgcacgatagtaactattattttccatatttatatagcaatctaagtcaagacattttttccataaagtgataaactcaataaaaactgtacatattatgctgtggaatacaggaggaaaatcatggaaaactgggaacaaataaatgccgttcaacaaatgcaaagttatattgaagaacatctagacgagcctatcacgctgcatgcgcttgccaaaaacgcaggctactcgccatggcattgcgcgaagatttttaaggaacttacgggcaagactccgtttgagtacatccgcatgtacagactctcgaaagcagcaatggaactgcgtgataaagatctgaaagttgtagatgttgcaatggatttcgtctttgacagtcacgaaggatttaccagagcatttcgcaagcagtttggcatgactcccaacgaatataagaaggccacgccgcccatttatctttttcatccatggcctatacgagattattattattggctaagagatgttcaagaggaagcaaagccacttgctaaagaactttttattcaggtccgcaacttcccaaaacgaaaactactgttgagacggagcgtaagcggtcatgattatttttcctactgcgaagaagttggctgcgatatctgggggctgctttgcagcgtgaaggaagcattgtatgaaccgatcggcttatggctcccggagtctttgcgtctgccgggcacgtcaagttatgcccagggagttgaagtgcctgcggattacaaaggccaaataccggagggctttgatctcattgatctgccagaatgtatgatgatgatattccaaagcgcgccttatgatgacattcactttcaagaggtgatcaccgggatgtcagaagccatagatcattatgacccgggacagtcaggctatgagtgggctgatgaagctgcgccgcgttttcagctggacccccaaggatggagaggatatatcgaggctaggcctgtcagggagatttaatcacgccgcaaggaaagtcaagagctgctttgttccttttgttatgatggtgacaacaataaaacaggaggatgcgaatgtggagatgaaaaaaagaatggaagggcatttacgaatgctttgtgaagaaatcggcgctcgcccgaccggatcagaggcgaatcgtgcggcagtagaatatgcctgtggggaattcgagcgatttggacttagtgtctcaaaacaggaatttgactgcatggattggagagaagatggagggactcttacggtggaaggacaggatatccctatagcccctgccccatattctcttaactgtgacttgcagggagaattgatccgtatccattctctggaagaacttcggacggcggaaatcaaagggaaaatcgtcttgctgtgcgatgccttggcttcggagccgcttatgccaaagagttttgtgttctggaacccggacgagcataaagaaacaatttccttgctggaaaatggaagggcgctggcagtacttacggtcagcctttttccggaacgctttgtgccgatgattgaggatggagattttgaagtcccatgcgcggtcgttctgccagagagcctgcccgaacttcgcagcggtgattatgctgcccttacgctaaaaacaaaaagatgtccggcaaaagcggccaacgttattgccacctatggaaacggggaacataaagtctgcatttcggcgcatattgataccaagccgggaacgccaggcgctctggacaatgcttcaggcgtagccgtattgcttgcactggcggagaaattgtcaggcagagagtttccgtatcgcatcgaattcgttttatttaacggagaagattattattccaatccaggagagatgctgtatctgagcactcatctttccaatccggaggaatacgtctgcgcttataatattgacggcgtaggcatcaaggaaaataatatcacatactccttttatgaatgtcctgaaaaactggcagacaatatatcatcgcttgccgaaaaaacaggaggttttgaacagatagagccatggcctcaaggggatcatacattgtttgccttttctggagttccggcaatcgctgttacttccagtggaatatttgaattgacagaccatgtgctccatacggaaaatgacacattaaaatggattgatatagaaaaacttgagatactggtaaattttctgttcgattcactttaagaaagattccatgttctctgctttgtgcggcagaagatgacaagccatagccggcggatgcagcccacacagtgtgcctgggctgcatccgccgctcatcttattattgctctatgagtccatataaaaacaatctgtggatatacttgatttttttcaggcatatcatcatccggcttccaccttttcccagtattattaaatagatctcatttttgctttcatttagcctggtattgtaaagtggaagtaaaagcaagttataactatatcgcatttatttgtaccaaatagttttacaattaagagtctgcatatcataatcaaaaatttctggttttattgattacagacattaaaagtttgacaataataattgatttagatatattattgaaaaattagcagataatattgtgaataaatagaaaatatattataatataaaagcaaaatactgctacagtattttaaatagtggatgttttaagaaaggaggaacgggaaatgaaacgatgcatatatatcaatattcttctttggtccgcaattcttttatgcggctgtgcaggaaaggctcaggagaaaaaaacgtcggacgcgccagaatggatcatggaagaaataaaccggtacaataacgaagacatgaggcagatagatattaaggaagacacaacggtttcagaaggaaaactggttaaggatgagactgtcatcatggacaaaaagaatcatttagccagcaatattggaacgaaggagggaccaggagataacagggacgagtattctatgttttttggaatggaaggcgcaaaggcttttgagatttacaaatataaagaacaggatcaattttataaagaaactgtttcagaggatctggcaaatctatatatagacggcagaaaactggaaatctcggataaggccaagatcaaagaggagggagaagagaccctggatgggcaaaaggcgatcaaagtaaaagtaacggacccaggctttgaaaggctaacagaccgagcggactataaggaaatgatagatgacgcgaaagcggcggacgcggatacataccaggaagaactggataaatatatggaactaaaagaaaaggaatggactttatggtttgacgcggagtcccacctgcttaaaaaagtcttttttgacagttccgtagaagacaattttaccttatatctactatcagcccaggatcctgaatccgactttgcaaagcagcggccaaaaaagggcaccacaatatggaatatcaagatgggcgacgaatgtgataccataaatctgccggaagaatataaagaattctaagcgatataggatcctgcatgcaggcaggaagaagaatatgcgtcattgggctaggcgaaggcggaggagtatgatagaatgcaagcagtatcatctttgccggagggaaatagaatgtttaacacgattccatttttgacgtatgtagtcgttgccaatatatcgccggggcccaatgcaattttatccttatccaatgccagccgatatccgttaagaaaggcgatccgctttaatttgggtattgcggtgggcgtgtttgcggtaatgctgctttgcggcatatttggcctggctgtgctggaagtgtttccgccgatacagaagatcctggtatgggtaggcgcggcttatatcctttggcttgcttttcagacgctgaaagatgaaggaaaagaagaggaagcgggagaaaaggagcccgggaacctttttgtgaaggggatagtactccagtttgtcaatccaaacaccatcttatatggcgtaacggcgttcacgacgtttattcttccttactataaaaaaccgatgtatctaatcgccttttctgtctttttgtcatggatggcatttgtggagaatggatgctggacggtgttcggctctttgttccagaagatcatcgtgcgctacaggcgtgcggtgaacgtgtttcttgcgctgcttcttgcatattgcgcggtttcgctggtgatataaggaaattgggattaagatttgacatttggggcaatgctatatataatgataacgacaagagatgtctgcgagccagtagtacagcgaatgatcagggcttgtactggtttcgacgggggtctggaagttggagaagccatccgtagcgggacactacgttaaaagttccaattaaatataaacgcagacaatagagaattagcgtacgctgcctaattaggcggcagtcggccccggatcttccgccgtctgggtcaccggcttcaaacaggcggagcacttcgtttccaaagctttgagggaatggaagaacttatgaagctactaaagtcggcagcctgtcattaggcggctgatggagggaatgtcaatataatgactgtgatgggagatgctttgatggatgggctttcggacgcgggttcaactcccgccaggtccactgtaaaagtgccgtaaatacggcacttttattttttgtgttgcatttcatgttgcatggtttcaaaatgagaattgattttgtctgtgaatttcttttgttcatccgagattacatttcgataaacctgtttcaatactctgtcggttttccagccgccccttgccatgatatactgatccggtattcctatcgcatgcatgatggacgcagaatagtgtctcaggtcatggaacctaaaatgagggagtcctgcagctttcaaaacagatccaaagtttttggaaatatcttcaggatgcatttttaccagatgcccttttacccccttgaatttatcgatcacaaaatccggatatacaacttcgcgataactagatccagtctttggagattttattataaagcctccgttgttggagcgtaccattgacttgtttatagttatggtattcccggatatatcttcatccgtgagcgcacagatttctcctcgcctcaaggtgccaaacgatgccagtaatacagccttttccaattcggttcccttgagatactccaagagcctctttatatcgctgtctgatggggtatagagttctctaggcttagcaggaggaagtttagtccttagtcttagggaaggctcgtaaatcgataatacggccgccagaaatccatgcgcattgctgaccgtcttgggggaatggttaagggaatattcatttgcccattcctgaatggcctgctgattaatcttttttgtcttcattcctaacagtgatgtatatgcgtttctaacaagggtttcgtatccgcgcacggaggttggagatagcacattgcgcttagaatcaatgtacttatccatagcctctttcaatgtgaaatcgctccgcttcatacgttctttattaagcgcgaattcggcggccagagcctctgccctacgtttcccggcaagggacggatcgtcacaggtgaaggattcatagatgcgcttcttttttacgccaccatcatcttgattgacatattcatagtgggaaaagacctggcagcgccaggatccggatggcagtttctttgcggttggcatgatatcatcctcctttttgggtataaaaataacagccagcgaacttccgttctcttgcggtggctgcccgaagatgatacaatgtttttgttaagaagcgtatatcttcggatgtatgttaggccgttcctggttgccgccaggagcggtttttattatgccttatatataacggctttatcaccgttatatgttttttctattttctttgttgataaagtttttcctattaatcctaaatcaataagatacatggtgcgtctgttccaataaatcaatctacattttccgatgcttccatcttgcaaataatatatttccccaaaataattttttgaagcgttaacatcattaaatgattcagtggcataatgtaatataagtggaaacttggatagttttccggtctttgtataaggattacattcaaaataagtaaaatactggttgatagtggtgtgttctattttttcgatatcaaattttaaactttcgacatcaatatgtaataaaggttttatttctgctatagcacacgattctttaaccagggtattaatgaattccatgtccctcttaacttgtaattgatctgaatttaaaatggtaattatgcacatgttattatcatatataggttcagaaagttgatagccatcaaaatgaaactgtttcatatccttaagcgaaatagatcttaactttttttccttctcaaactgctcagtttcttgtcttatgcgagcctgcttttcttgagcagattctcgttttagaccattccattcaaattctgatattttagggtaacaagtggattttaactcttctggtatgtgagaataataacgattaacatgctctctaagaacagtatctattccccaatcctcctcattaattgaaaaatgagtttcacagaccgggatactagagacgcttttaggtgaatcaatatcatagcattccccttgaataaagtaataacgcggcaaagatgagtactgtgaaatttcaacaccataaacgttatgcttaaattcttgttttgaaacttcgggttcatgttttttaaataaattatcaaaaaatcccatatctatttctcctttctttgcttttttacgttgagtaatctatctttccaactgccaggttggggataaacataatgcaatagtcatcaactgatgtgcatattccatacttgtctctgtagcaatcgatggcgtcctgaagaaattcctcggtgacttcaagatattcagcgatttcatgtcttgagcggcacccgtgctcgtatgcccgtatcagcccgtgtaatccgatctgcttattgtatgcccagaaacgggcctggcgctcctgtttgcgattctccagattatccagatcgattatattgcctactgtagtatgatggtgccctaattcctctgcaaggacacaggccttctgcactgtggtgtcaatatcctctcttattgcaatccgttttccctttattctaccgtcactggcctttaaaggcttttcttttacggcaagacctttctggctggcgttgtctagtaataattcatagttgttcattcagttactcacctcgaccatgattctatcataacacatgtccgatttattggacttagaagtcatcgtcatccatgatttcatcatcatgtttcttcatttcatcgtttatatcaatgtcggtgcgtttgtgggcggcgctgagtattggtaactcttctagggtaccattatcatgaaacgtgatatgaaaattctttgacttggtaatttcggctttatactctggaatttttgtgagaagttccacctgctccagagctttatcctgcccctgttcgtttaataagaaaaacaaatcctgcatttgttcttctttatcatctcggttcttaaaggtatcagacccttccaaatcctttccgaagtcttcagcagagtattgagaccaatctacgattaattcattcatatatacgcctagtgcagaagctatttttcttacagtttctaatttaggattagctttaccaagttcgtattttctgatttgggactcatacatcccacaaagttcccctaattgtttttgagttaaatttttttctttcctcagttttctaatattatcaccagtagtcatagtaactacctccttttatataactatatcacatattttaagatttgaacagatacaaatttatctataaaaaacgattgacagataaataagtatctgatatactttcggataacagataaaaaagtatctgatatacgaaaggagggtatctgatgttagcagataggaagaaacttgaaattgcaatggctagagcatgtatgaatacagaagatttacaaaaagccgcaaatatgccgcgacctaccttaaacaatattattactggtcgtaatataagacctggcactattggtaaagtagcaaaagcattgcaagttgacgtaacggaaattctggcagaggaaaaggaggattgttaatgaacgatttaagcattggataacattagaagtgttaccacgttatctggtgagatatggagtaaaaagttcacaaaaagttcacattttaaagtttagttatctaaagataaatttagttaaataaatctgccagacggtactaaatttacgttaactaaatttgctgtttagttaagaagaatggctcaaccacgcggtttacaagcatttttagaggtgctatgatacgtcaaaacaagaaggaggtggagaaggatgccaagagtaaaactggggacagtagaactggatgataattaccgctactacctaaaacatattatggtagatactcccggtaagaaactatgcaaactcttgaacttaagcgaaagttgtctgtacttacacaaaagaagaccagaattggtgaccgtacgggaactccgtattctaagaagtacaggacggatgacggacgagcaaatattagcaattataagaaaggaagacaagccttgaaacaattcatatgggatttagttacgggatttcttgtcggcttagcagccggagccgggatcatcatagtagtgctgatctactgccggatggcggggccgatgttctaggaaggaggaaatcaggatgaagcattataggatatgcatacaggcggagaggcatgagtttgactatgtatgcagcacgatcagcgaggcatacggcgcggtcgaggacgcgtcgatcgcatttaatcttaacctcgacatggatagcatcatgcgcgtgctggtcgatatggatcgagggatccttattgagacggatcggcatcgcatccggatacgtgtggaagatggagaagtgtagatgggaggtggaaaggaatgacggaagacaagcagaagatactggatctgctattgccggcactgcaggcaacccgcaatctgcatgatctcatgtcgctggagatcgacgcggagcaggaacttgtgtatgcgacattcgagagcggctaccaaaaggttgcgattgtggcatgcgattccgggacaagcatgatccgggacgttatcgggcagatcgcgtaaaaagagcgccttcataggccggcaagcctcgggcgctcaaataatcaatcaactaaattataacagatatggaggaaaatgcaaatgatcaagtgcgataggggagagataatcatatccggcaatattgctgtgatactggcggaatatggcacccttgcaaatgcaataaaaaagagcctggtagaaaaaggctttaaagagcctgacgcaaagaagatgatagaagattccgctgaagccggattccttacatcggaagaacttgacaggaagatcgatgaactttcgaagaaattgttcaaaagattattctgaggagggggagcatgcggcgtgcaaggacacaatatgcgccccttacatcagaggagcaggaattcgcggcagaaaaccattacatagtcgagcagttcctgcgacagcgcaggctgccagccagcgagtggtacgatatcgtgatcttccgctacctgctctcggtcaagaaatggtttgcgactcctgatctgcataggtggacgttcccaacgattgcgaagcaggacatgcgctcggcggtcagcaacgaatatggaaggcggaagcggcagatcaggaccataagccttgacagcatcgtgccagggacggaagacctgaggataatcgacatcgttacggaagacaaccttaaattcatagcatatatggaggaagaagacatgaatataagttataacatcaaggttccggaaaggagccgaagaagagtgggccagaagagcgacgaggttctggcactggaatcatttttagagacgaagaaactgaggaatatgcagatcgcatatgaaacggcggatgaggcaaagaagaaactcccgtccctgcagtcatacaggaggacaaaggggctgaaggagatcctggagatcttccgggtggacacaagcatctatgtagtaaggatataggaagggaggaaatatgatggatagcatcaagatcaacaagctggagattgagaacgtcaagcgtatcaaggcagtcaagatagagccaacatcagaaggattgaccattatcggcggaaacaataaccaagggaagacctccgtgctggattccatagcatgggctcttggaggggacaggtaccggccatcacaggccgtacgggatggctcggtcatcccgcctaacctgcatatagtcatgagcaacgggctggtcgtagaaagaaaaggaaaaaatagcagcctaaaggtaacggatccggaaggacataagggaggacagcagctgctgaatgactttgtggagcagctagcccttgatcttcccaaattcatggaggcttccggatctgaaaaggcgagaatcctgctgcagatcatcggagtgggcgaccgccttatggaattggacaagtcagagcaggaactatatagccagcggcttgcagtcgggcggattgcggaccagaaggagaaatatgcgaaggagcagccgtattatccggaagcgccgaaggaacttgtatctgcagcggatctgatcaagcagcagcaggagatcctggctcaaaatggagaaaatcagaggaagcgagaccatgcaaataactataagcagtcggtagcattcctaagccaggaagtagaatccatgcgcgcgcagctacagaagaaggagcaggaactggaggatgcaaaagcatcgctaaatacagccatgatgtccgcccaagacctagaggatcagtcaactgcggaactggaagagagcattgccaatatagaggagatcaaccggaaagtacgcgcaaacctggataaggataaggcggaagatgacgcgcttgattacaggaaccagtatgcggccctgacaaagaggattgaggaaacaaggaaggctaagacggatctcctgcagtctgccgagttgcctcttccggacctgtctgtgaaagagggggaactgatctacagggggcagaagtgggacaacatgtccggctccgaccggctgaaggtctccaccgcaatcgtccggaaactgaatcccaaatgcggattcgttctcctggataaattagaacagatggatattcagacgctgaatgaatttggacagtggctggaacaggaggggctacaggcaattgcaaccagggtaagcactggagatgaatgcagcatcatcattgaggacggctatgtgaaagaacagcaagaagttacagatcagatgccagaatatccaaaatggaaggaaggagagttttaatgaaaataacaagaggcaagattccctgtgcgaaaaaggtagtctgctatggcccggaaggcattggcaagtctacatttgcaagccggttcccagatcccgtattcattgatacggaaggaagcacgaaagatatggacgtggccaggctttcgcgtcctacaagctggacgatgctcttggaagagatccagtacataaagagcaatccacgcgtgtgcaggacgctggtcattgatacgattgactgggcagaacagttatgcgtggagcatatctgcgcaacgcaccataagtccggaattgaggattttggctacggaaatggctacgtatataccaaagaggaatttggacggttcctgaaccgcctggaggatgtagtcgaggcaggggtcaatgtagtgctgacagcgcatgctcagatccggaagtttgagcagccggatgagatgggctcctatgaccgctgggaactgaaactagggaaaaagacccaatcccagacctcgccgctggtaaaggaatgggcagatatgctgctattctgcaattataagacgtgctccatagcggtggacaaagaggggaaaaagcataaggcgcagggcggaaaacgcgtgatgtacacagcccatcatccatgctgggatgcaaagaacaggtatggccttccggaagaatgcgaatttgactattccgttattgccggaattattgaatgcgtccaagaaaaaaaggaaagcattgcctatcagaatacggcgggcgcgtcaacacaaacagccagtcccgcagatggatttagagatatccctgaaactgcagatgagcaggttgatttcaatacgggagaaaagattccgaaggctgaggaagcgaagaaggagccagagggcaagccgccaaaagagccggcggatatgtcaaaaagcgagacattccgcctgaatgactacataccaaaggccctgcaggatctgatgtatccgagcctggtatcggaagatgaactcatggaagccgtctacaagcgaggattcttcccacgcgggacgcctttccagaatcttccgcaggagttcatcgaaggctgcctgatcggggcatggtcaaaggtgatgggcgtaatcaatgaaataagaagcacttacaagataccatttaatgaataatagcaggaggcaagaaagcatgagtgaagattatagaggaaaagagatcggatgggatgatgaagtcgagataggtgataaatacaccctgatccccgaaggggagtacgactttgtggtcgagagttttgaaagaggacgctatgaaggcagcgacaaggtgccgccgtgcaaccgggcgctattaaagattcgtgtagatgctccggaaggaatagcgctcatgagcgagagcctgctcctgtatgacaggatgcagtggaagcttggagaatttttcctatccataggagcagaagaggtggatggaaaactcaggatgaactggcagatggttccccaggcgactggacgagccataatcgagatccgtccagaccggaatgatccgactaagaaatacaaccatgttaaggagttccttccaaagaagaagaaggagttcaaggcaggtgagttctaatgaaactcaggccatatcaacaggaagcgaaagatgccattttctccgagtgggaggatggcatcaaaaaaacgctgctggtgcttcctacgggatgcgggaagacgatcgtctttgccatggtcgcggaagaatgcgtgcgccaaggcaatcgagtgctaatccttgcccatcgtggagaactgctcgatcaggcggccgataagattgccaaggctaccggcctgggctgtgccgtagaaaaggcagaagagacatgcctggggagctggttccggatcgtggttggatccgtgcagagcatgatgagggagaagcgtctgaagcgtttcccccaggactattttgacaccatcattattgacgaggcgcatcacagcatttctgacagttataagagagtgctggagcattttggggaagcgaaagtccttggagtcacagcaacgcctgacaggggcgatatgcagaacctgggcagcgtatttgacagcctggcttatgaatacacgctgccaaaggcgattaaggaaggctacttgtctccgatcaaggcggtcacgataccgctcaagatcgatatgagcggcgtaggcgttcagggcggagactttaaggcgggggatattggaacagcgcttgatccatacctgcgcggcatagcggaagaaatgaagaactactgcatggataaaaaaacggtggcattccttccattggtgaagaccagccagaagtttagggacatcctgaatgagaatggattccgggctgccgaggtaaacggagagagccaggatcgggccgaggtgctggcagattttgaagccgggagatataacgtcctgtgcaattccatgctgctgaccgagggctgggactgtccaagcgtggactgcatcgtagtcctgcgcccgacaaaggtcagaagcctgtactgccagatggtgggcaggggcacacgcctccatccaggcaaggatcatctgcttctattagatttcctctggcatacagagcggcacgaattatgccatccggcacatctgatctgcgacagcgaggaggttgcgcagaaaatgacggagaacatggagaaggatgccggatgcccgctggatatcgaggaagcagagaaagcggccgcagaggatgtggtcgcccagcgagaggaggcactggcgaagcagctggcagagatgaagcgccggaagaagaaactggttgacccgctgcagtttgagatgagcatccaggccgaagacctggcaggctacgtgccggcattcggatgggagatggcgcctccttcggacaagcagaagcagacgcttgagaaactaggaatcatgcctgacgagatagataatgccggaaaagcggcaaagatactcgaccgccttggcaagaggcgcgaagagtggctcacaacgccgaaacagatccggtgccttgaaaagtatggctttcagcatgtcggaacctggcagtttgagacggcaaagagattgatagatcggattgctgggaatgggtggaggattccatctgatatcaatccggcagaatatagaggttagatatggaacagagaacagacttgcttgaaataattgaatacatcaaccctgcggaacttgattaccaggaatgggtcaatgtcggaatggccttaaagcacgaggggtatcctgtcgacacctgggatgcctggagcaggaatgacagccggtatcatgcaggcgagtgcgtgaagaaatggaataccttccgcggatcctccgttccggtcacggccggcacgatcgtgcagatggcaatagaccatggatggcggccatcctatggcgggtatagccttgactgggatgatgagatcagcatggatgggcttgtgatagaagatgccggctgggtggaaagacaggagatccgggaaccgagggaatgggatccggtgacagagatcacaagataccttgagacgctgttcgaggccggggagaatgtaggatatgtcatgggaagctggaaaaagactgacgagaagggggagcggtggctgccgcagaaaggcacatgggataggacggcagggcagctgatagagctgcttgccaaatgcgatggggatatcggcgcggtgcttggggattacaatccggaagcaggagcatggatccgcttcaacccgatggacgggaaaggctgcaagaatgaaaatgtagcagagttcagatacgcgctcgtggaatcagacgcgatggatctggaacagcagaatgcgatcatacgagaactggaactcccagtagcatgcctcgtattctctggaaagaagagcctgcacgctatcgtcagagtagatgccgcagactataacgagtataggaagagagtggactatctttatagcgtgtgccagaaaaatggcctcaagatcgatacgcagaataagaatccctccaggctgtccaggatgccaggagttacgaggaatgggaagaggcagtatattgtcgatacgaatataggaaaggcgaactggaatgaatggcatgagtggatcgaaggaatcaatgacgatcttccagatccggaatcgctggaaggcgtatggaacaaccttccggaactttcctcctgcctgattgacggcgtgctgcgaaaagggcacaagatgctgatagcaggaccatccaaggcgggaaagtccttcgcgctgatcgaactatgcatagccatcgcagaaggccgccaatggttcgaatggaattgcgcccagggcaaggtaatgtacgtaaacctggaacttgatcgggcatcctgcctgcatcgctttaaggatgtgtaccaggctctaggatggcaggccaagagccttcagaacatagatatatggaacctgaggggaaagtccgtgccaatggacaagctggccccaaaactgatcaggcgtgcagcaaagaagaattatgtggccgttatcatagacccgatctacaaagtcatcaccggcgatgaaaacagcgccgaccagatggcgaacttctgcaaccagtttgacaaggtatgcaccgaacttggatgcgcggtaatctactgccaccatcacagcaagggcagccagggaggaaagaagtccatggaccgggccagcggatccggggtattcgcgcgggatcctgacgcgatgcttgacctgatcgagcttgacattacggatgaccttcgcaagcaggaagagaacaaggccgtatgcgccgtatgcaagcggtatttggacacgcattatgaatgggaggacgagctctcccaggatgacctgctaagccaggcacgcatgatggattactgcaaggagcatctgggtcctgcgcgcatgaaggaactgcaggcgcagatagatgaggaattaaaggctgtaagcgttaggacggcatggaggatagacggaaccttgagggaatttccgaaatttgcgccggtcaacctatggtttgattatccgatacataggcccgatgatgtgggcagcctgaaggatatccagccggatgaggaaaagccaccctggcagcgcggtactgacaagatcaagaagaacgcaaaggatcgaaaagccgaccgaaaaaaagcgcttgaagaagccattgagggcagcaattttggggaggcccctaccataaaagatgtagccgggtatctcggggtatctgaaaggacagcccgtgaccggataaaagagcatggcggctatacctatgaggatggaaaagtaagaaaaaagggctaaggatcagacacggggaaaccttaaattccagattaccccgtgagaatgaaaggtgaaggggagaccttaaaatcagatttccccgcacaaaccatcatagcggggaaaccatattttttagattcccccgtcaatgacagatacggaggggaaaccttaaattccagattcccccgtgcggcggggaaacctataccctaacgggtaaatatttcccccgcagtcgtgaggtcacgggggtaggagagggacgggcctaaggctgtccggccccgtctcccttccccctccccgatgataaggccgaaggaaaaagaaatagttcaacactttaaaggagaaaagcaaaaaaatgatgactgaattttttatgtctatgataccgccgactgttacgcaccaggaaaagcaggtacatgtggtgaaaggaaagccggtgttttatgagccgcaggacctccttacagccaggacaaaactggaagcgcatctggccagacataagctggaagaaaagtatgtgggtcctgttgaactcgtaaccaagtggtgcttcccgcgaggatcgcacaatgatggggaataccggacgagcaagccggacacggataacctgcagaaacttctcaaggactgcatgactacggtgggtttttggaaggatgatgcactggtggttcgggagattgcagagaagttctgggcggaaatcccgggaatctacataagggtgactgaattatgatggctgttaaagacgcgtacatgatgatatgcgatgcctggatcctgtatcggaactatgcggcaagcgaactgacggatgaaattcttgaaagaatggtcggagaagtagaggaacttaggctgaaatacaatgccccgtttgcttctggtattcttacagccacggttttggaattgggaaggatcgcaaaaaacagagaggtaaattagggttttgtgaaagaaggaaaaacatgaaaatagttgataagagtaataatgaatctctattcttcgagagccttggattgggagatgtattcaagttcgatgatagaatcttcatgaaggtatcaaataatggagatggagaaaacaatgcctatgattttagaaaaggaagattaacagaaattagcgaagacactctcgtgcaatatgttccgagtgaattggttttgcatgaaagaggctggaacttaaatggctaaactgagatttaggaggaaattaatcatgcagaatgttattgaaaaggcggtatttaagataacgcaagagatggaaaggaatagaaaggattataatgaaactgctgactgttatagagataccgggtatgacaggtactgggacaagatggagcgcctggaaaaagaatatgaagaattaaaaagttttcttggattaaattcgtccacccaaaatgcaagcgcagaaagcactcggttatatgcagagaataaagaactaaaaagatttatcaatgatgcaaaaagccttatgacctatattcatgcggattattggagcgacccacaggttcagcgtctttatgaaaaatttagagattttaactaaccggggatttagcagacaaaaaagttgccagcaggcccacacagtaaatggtggtttaaaagcgggcctatgtactggcaacaagataattataatgcataagcaccaaaaaggcaaacagaacaaacgaaatggagatgatagattgaagaggcagaagagggacaggcatactgcgaagggcgatagggacgaccgctttgcgcagatgtccagcagggatcccggagagaaggccagggagcggatgcgcaggccggcctacgccccgggggagttatccttccaggcaaggcgcctgatccggcaccaaggcaggcagatggaacatgagagcgtagaccagtatgtaaggaggcaggaacttggaaagagataattacggaatcatggaaggatataacaacctgctggtagccgtagtcaagcaggcggcaatagactaccgcagggcgctgaagcggctgatcaggaagccgggcgatccggagtcgcggcagatggttgacgagtgcgagcggttcttccggcgcgacatggggaattacgtgaatcttgacggggagaaggtcatagcggccctgcgcgagaaggtctacaaggagatggggatatgccgctgaaagatgcctttagccagtaccagaggaacaggcgagagatcgcgctgatagatgccgcgctggccaggctagaatcgcagcttgatgaggtcgcgatcgttccgggcaaggtgacgaaatccagcgacgattacccgtacatagaggagcatgtatctgtcgagatcccggagccgagtgaggcatcccggattcgggagaagatggctgcgaaggagaagaggcggagcgagatcgcacgggagatgcgcatggtggaggagtatatcgaggggatgccggagggcatagataagcagatcttcgagatggtgtatcttgacgggatgacgcagacggaagccggagaatcagtgggatatacgcagggcagagtatcacagatcattaagtgctggataaaagattaataacattaataatttagatgtgctattattatactgacagaagtggatatgtgaatcccatatcgatttcctccaagtttatgataacagccgagatggcgtcccgcaggaatgcggggcgtctttttcgttgaaaattattagccttttttgtaattaattattaaaaattgttaatatatggcacaaattggtctcaaatacttgaaaaaatatagaaaatattctatgatacaagtaagaaaaaaacgacttgtttttacatttttttcacacctcttttgttatgctatgcaaagacaatcggaggtggttttttgacacataaaaagaacaaaaagaaaaaaaccaaggaggaaggtactatggcggcaacagcaaagaattatgcctatgaagtacgggccaaagagggcaaaaaaataatggctcaaccggcggtaagtaaggcatttcttgaagattgcaaaaaggttgcgcagaagtatcgcagaaggaagtaatgccaatctatcaagatctaatgtctaaagaatacattgagatagcaagggaatttcgggttaatccagaacgctgcgataatcccgcgcattatgaaaattttattagacaggattgttttactgaccagaaacaaggcatgggtgttacccatgtctttgttgacgaaaatgagaagacgaaaaagaaaagtttagccgggtacataacgttaaggggaagttctctcgttatggaaactggagaaaattataaattaggttttcctgcattagaaatagcggaattagcagtagatcaaaattatgaggggaaggggttagggacggatatggttaagttcgctataaacgaagcagtggaattgaatgataccagaattggatttcagtatgtaattctttgtgctgatgtagctgctgttgaattttattctaattcagaattaaagtttaagcctattcgtccaatgcaagaaataccgagggagcataggaacagtaattgcactccaatgatgttgaaggttattcaaaactattaagagagttatataatataagttataagaacggcaccctccggggtgcttttctaatgcagaaaattaagccggattggaaggtgaggtgatggccaataatgaaaacctagtacgcttaagcccgagcgaagcccgagagaatggcagaaagggcggcaaggcctcaggcgaggcaaggcgccggaaagcgaattttcggaagacgctgaacatgctgctgacgaccgagatcgacagcgaggaatggacgccgatccttaagtccctggggctggatagcacacttgagagtgcgcttaacatggccatgatcaaggaggggctggcgggcaatgtcaaggcatatgaggcggtggctaagtatgcagggcaatcagcacagaccgaggcagatgaggaagagcagcgtatccgtaccgatcgcgcaaaaagggcgagagatcaggaagtgggagacgttgattatgtcgaggataacatacagtccttcctgaaagccatgaacccgtcgcaggaagatatggacaatctatttgcagaggagggtaagagcgatgccgaagaagcggaagagaccggcgaaatttgattttaagccgttctcagaccagcagcgcaggcttattcactggtggaggccgatggtaagcgcgtcagaatgcaattatgtgatagcagatggatccatccggtcaggcaagacgattgcctgcattatcggttttcttacctggtcgcaggaaatgcacagcggacagacgtttatcttggctggaaagacgatgggcgcgctgaaaaagaatgtcatccggccaatgctgcagatgctggaagcctggggatggccttatgagtatgtgagatccgggtcagagccgcacattgacataggcagcaatacctattacctgttcggtgccaacacggaggcggcacaggactccctgcagggattaactgcagccggcgcctacctggatgaggcggcactgttcccgaaatcctttgtagatcaggcaatcggccggtgctcagaggatgggtggaagttctggatgaactgcaaccctgctggaccgcatcatttcatccgggatgaatacctcgaggaagagaagatgaggagaaagaaagtataccatctgcatttcacaatggatgataacttgtctatttctccgaagcgtaagcaggaatacaagaatgcctggccgcatggcagcgtcttttacaagcgctttatactgggcctatgggtggctgcggatggcctgatctatcagcagtttgcggacaatgtagaaaactacacagttaccagccagtggctgcaggataatccaattcaatatgcagtaataggagtcgatttcggtggcacgaagtcggctcattcttttacactgacaggcttcacagcgggatttaagcaagttgttgtcctggatgagtattactgcaagaagcggattaatccgaagcagcttcaggatgattttattgactttgtccgcagagcgcaggcaagatacaaggtgtatgaggcttactgcgacagcgcagagcagacgcttattgcaggactggaaatggcgtgcatgcaggctcgcgtgagtataggaattcagaatgcgatcaaggggccgatcaatgaccggatcgcgttctacaatagcctgattgcgcagggacgctggaaaataatgggacattgtacgcacatcatcgaggcgttcgagcaggccgtgtatgatgataaacgacccaatcaggatgtccggctggatgacggactgatgaatgtggatagcctggacagcacagagtatagtaccgagagtgtgcaggatgacatcctgtatatcgcggcataaggagagtatatatgagtaataaaattcaacagtatttgcgggatcacaagtataacacggcgcctgatgatacatacagccatattgataagtggctggaatggtatcagggggatgtggagaaattccatacatacaagatatataacggatctatgactacggagcacaagcggtacagcatgggcatggccaagaagatctgcgaggactgggcgaacctgatcctgaacgagaaggtatctatcaaggccggaagttacgaggatcgcctgaataaaatcctcgaagccaacaacttccgcgtccgcggaaaccagctgctcgaactgtcctatgccttaggcacgggagcattcgtggaatatcttggcgcggatggagatgtcatcatcgactatatccgggcggacatgatctatccgctatcctgggacaacggggatatcacggagtgcgcatttgggacaaccagggtaatgggcggcaaggagcggatctatctgcagatccatcgattcggaagggaagaggacggggaaaggccagacgaatactacattgagaatagatatatcgatgcgcaatcaggagatgagatagatcccccggatgagatagagccgatggtcccgaccggatatggcaagccattattccagatcgtatctcccaatatctgcaataacatcgacctggacagcccgctcggcatatccgtctatgccaacagcatctcgcagctgaaaggctgcgatctggtatatgacagttacatgaacgagtatattctcggccgcaaacgtattctggtgcccatatctgcggctaagatgcagatgcagcaagaaggtgttgcagtgcccacatttgaccccgctgactctgtatattaccagatgcctgcagaccgccagaatgacctgaaactaacagaggttgacatgacgattcgggcgcaggaccatgaacttgggatccagagaagccttgatgtgctgagcctgaagacagggatggggacgggaaggtaccagttcgattcggccggggccggagtgaagacggcaacggaagtcatttccgatcggtcagacctctatcagaatcttgagcgaaataagattcctgtgcgagcggcgctgcagaaccttgtcagggcggtatcctggctggatcagggcatggaagcggaagcaaccgtggattttgacgactcgatcatagaggatatcaacgctacgatcgacaggaatatcaaacttgtgcaggctgggctccgctccaggttcacggcaatcaaggacattgagaaatgcgctgacgcggatgcgcagaaagagctggatcgtattgcgggggataatcagataaccggacaggacattgactggacacgggaagacgatccggacgatgagggagaaggcagcgaggaggaggatgcagatgagcctgaacctgttaaggaaccagcaggcagcggagagcattgacggcatctacaatgacctggaagcgcagctgatgcggaacatcgcgcgtcatcttagagactggaaccagcccattgatacggaccgatggctgctgcagaaacttgcggaaatcggccggcttaatcaggagaatgtcaagacaatcgcgggaatgtcagggcttagccagacggcggcccagcggatgctgatggatatggccgaggaggcagtcaaggcagtcgacccggggcttaggcatcttgcacggatggggctggccggagaagcggtagcgccaagcaagagcagaaacgtcaagcaggcaatagcaggcctgagaaggcaggccaaggacacgcttaacctctgcaatactacgatgctgtataaggcccaggatgcatataagggactcgtgggggatattgcggctgaggcgcatcagattctgggaagcgaggcggccggaatagtcgggggcgcggaatcgcgccagcaggccgtgcgaaaatgcatccggaagttcaacgagaagggcataccggcctttgtggaccgacgcgggcgggaatggactcccgaagcctatgtcaatatggccatgcgcaataccgcgaagcaggcagcggaagaagtgcaggacgcccggtgcagggatgcggaagttaatctgatacagattgattctcattccggagcgcgccccaaatgcgcaaaagatcagggcaagatattctccctggataatacaagcggcgagacggaggatctgaatgggcggaagatcaagtactatccgtggaactcttccagttatggagagcctgatggaatccttgggatcaactgccgtcatcacaaatggccgtttctcccgggagttaatatacagcgttattttcctacggaggatatagatgcaaacaataaactgtacaaggagacccaggttcaaagagccttggaaagggatgtgcgcaagcagaaaagggagtgcatgctctatgacgaaatgggggataaagaggcttttgaggatgcatctgtaaaactaaagcagaaggaagcgaaactgaaagcatatgttgacagcaaggagcacctgcaccgcaggaaagaccgtgagcaggtggttgggtttgataagagggtatccgcagaggcagttggaaaatcacaggcgcattataaaaactgggcaaaatcaatcggcgcagagtccggaccaaaaacacttgcgggatactatgatttgaaatacaatgatagtaaagaaagtcggttgtacaagggatatatcaaggcggtagataaaggaaatatttctccgctggttggatataacaagtttaaagaaatagcgtctgaaacagagaataaatttgttggaatgaaaactgctgatgggaatgaaatctcgggaatcacagcgcactttattgaccgtgtgattggacagcaatcagctgacagcccgccaagaaaaggaatccgaaacggagttgaattatcggatatagaggatgcaataaataatccggctaagataggaccggttgtcacaaaagacaacggaaagaaaagtaaaatatattatggctccaatgctgcggtatcatacaatccagataccggagaattaatccaggtacagcctaagaggacaaagtgatggtaaagttaaaagaaaaagatgaaaaattcataaacgaaaattttgataatgcaaacgaaatccttgctttggatgatttgaatgaagtgctggatgagttgtttctttggatggaagtccacggccttgatgaagatgattttccaaatgaaaaaggcgaggctgcccagaaagtgtatgatagtatcctgcagtatgaataaaccactggtcgaatcagtctggtggttttattatgtccatttttaaggagggatgtatattgattgaagtaagtgtccggaaggatggtataacagtagatggccatgcaaattatgcgccggtcggagaagatatcgtatgtgccgctgtatcagccattacgcagatgctgatcaagtctatcgaggatctggcggccgacaaaatcgaatataacatatcgcccggaagggctgatatagattacaggaatctatcagagaaagcaaagactctggtggattcctttttcattggcgtctgcatgatcgccgatgagtttccagattatgtccggattatatgagtccatacccttgctggtgacgttaaactgcatgagaagagccatacgggcgaaaaacggaggtagaaagatgaagcacatgaacatgaaggaaagattttggcctttggaactgcaactgtttgcagaagaaggctctgacggcgatgacgccgggggtgacgacccggacggaggcgatgatccggacgaaggcggagagggcgaaggcggagaagaagagccgaagtataccgagaaggatatggaggcggcgatcaagaagcgcctcgcacgcgaaaagcggaaatgggagagacagcagagaaagcccgaagataagccggcaggcggtgatagtagcaaggatggtgctggagacgagggcgaaaaggacgctgagacagaagcattgaggcggaaggccgaaagggtagaggaaatggaactgaaatggacctgcctggattatgatgtggacaaggcctgcgtagatgatgtgcttgcgctggcgcgggttcatatggccaaggataaggattccgacatcgaggacgccattgatgcggtgcttaagaagtatccgcagttcaaggcatcatccaaagatcgggatgatgacgatgatgccgatgatgccgaaggagcaagaggcaaggcctggggacagagacagagcggaaggaagaataagacttccggagtcgaggccgaattcctgaaaaagaacccagggcttaagattgattagattagaaaggatgaaaagaatgaaattcaaaatgtttttacagttgtttgcccatgcgcatcaggaaagatggtctagcctggtggatgcgaaactcaggcagacgcttgtgacaagagatgagcatatatttaatgtaaactacgagggaaaccctaaggctggcagggtcaagatccctgtaagggatacagaagtcaccgtaagggactatgacaaggcgattggcgtggatctggagaccggaaccaccacctatatggatctggatatcgatagggacaaggctgtcaacgaaatgattgacggctatgatgctgcagcagtcccggacaacctggtggctgaccgcctggattctgccggctattcgctggcgctggagatggaccgggaatcgatcaatgtcctggagactacagccggcgtcaatgtatgcgccaccaaaacagcagcaacggagggcaccgcatacaaggagatcctggcagccaagacctaccttggcaggacaggagtgcctcaggaaggacgctggctgatcgtctctccggaattcatgtccacgctgatgctggacgatcatttcatccgccagggcgatctgtcccagcagatgaaggacgccggggcggtcggagcagttgcggggtttgcggtgtatgagtccaacaacctgatgtttgaggacacgaaggccgtaagcggcaagaagaccaccacggaattcattgccggccatcccaactggtgccatcgcgtacaggagtgggccgtggatgtgcatgcgcaggatctggcaggatccggcaagtacattggcgcatctgccgtgcagggccgaaagatctatgggctgaagatctccaagccgaagaccgtatatatcaagcgcacagaaactgcggcgtagtaagaaggaggcggtctggatgccgtatataacaatttcatactataatgatacgtttcttggggagccggtaactaaagccgacttcccatctcttttggcgagagcggaagaaatcatcgaagaaatgacgatgtaccggcttacgctgcctagtttcaacgagatgcctgaaagcatgcaggagcgcataaaaaatgccatatgcgcgcagatcgagtacctggatgcgaatgggggcagcgagatggacaacggaaccggcctgcagagcgccggccttggaaaattcagttatatccaggcatcggggtcagacggaagcgcgcagcagcctatctatgcgccgcgggcaatgcgcatattggctcctacggggctgctataccggggaggtggatactaatgcgtccgatacccaaaacattgctcatacacgccgtcacgcaggccagagagggagaagcagaccgctggggcaacggcggattgacaggggagcaggaactgcagcatgtccggatggagcccagcagtaaggtgatccgggacaagaatggcgcagagatccagcttgcagcaacactcttctatgactgtcggaacagccggcccaagaacatcctatttcagacagatgatatcatcatcttcaatgggcagaggcataaggtgcagacggtggagccgttgtacgatggggcgaggctccaccattatgaaatggggctgatcaggcatgcctaagataagcacgcgagtgacgttccaccgctcccaggcggcggcactgatcaaggcatcgagcaattacgggctgacggctatggggaatcaggcgctgcaggatgccagccagtatgtgccgcaggaccagggggatctggaagggagcggcctatccaacagcgacatgcaggcggccaatgggaagttcgcgcttaaatgggcggagccttatgcgcagtacctctggaacggcgatgtgatgtatggaaaccctacaaacaggacttatgggccgaagaagatctcattcacgagtgccctggcaaggcaggaatgggccaaatatgccagggaagtgcatggcgcagagtggaagaaggtctaccaggccgctatgaaaaggaggatgcgacagggatgacgccgcagacggaatttttggacctgatatgcgatacggcagagcggaactgcgatcttggagcggaaatatcgcttaaggaactccccgcagagggaggcatatatgccgaactcggggaggggatcggggacagcccctactatgacaagagcgcggtgcggacgatgccagttctgttcctctgccgcgatgcggatcagcgcagagggatggacaggctctgccggatatgcaactacatgcaagggctcaggcagtatccgcaaggcaggacagtatcctggctggacgcccgagtcgcaaaagaacccaacaagataggcagggacgaggacggggtctatcacttctcctgtatcctcaactgccagatatatttttaagaaaggaagaaaggaatatggaaaaaatcaatctgcaggtatttgcagaacccgcgcttccggagaatccgattaccccggaaatcaactatgagaccgaggcgtatatcaatacggctccaggagaatctaccgcaaagtgggcatccctcgcaaatcttacgcagaacatggcgcagtcgctgaacgaggtgctgcagcagatcgcgtattatgcggacaaggggtggagctccacggaggtcacgggcgcgcagatgacgcttacccttacaggggcagtcaagccaaatgatgaggcctgcgactatataatgagcgatgaggtcatgtatgggctgggaaatgcccgcaagacgcatctaaaactacagaagggcagcaaggtgatcatctggccagtgacgctggccaacatcacgcctgcatatggcgacgcgactgcgactaacgcgctgacggtcacgctgcatggcaatggccgtccggtaatcgggacgacgacaggggcataggggctggattaccagccctcattaggaggtagaaatggcatatcagataaaaagagagaggcagtattttgccgaagacatcgaactgcttgaccaggacggcagagtcgtgctatccatccatgtcgcgcttgacccggatagcgtagtcgagaagataagcaggaagtatatagaccttgtacatatccagcagtccttccagggatttgacgcgtcagctaagaatgaagcggaagtgcaggaggcttatgcaaggcttgggaatgcggtgattgccctcctcgaagccgtattcggaacagcagacacgagacggctgcttgactactttgatggcaactatatcgagatgatgcatcaggtcgggccatggatcgagaacgtggcagtgccgcggatccgggagatcgcgcagaagaacaagcagcagatcatgaaatcatatggccgccgggcaaggcgccggaaaaagaggggatagccatgtttttgacggaaaggcttgcagacagggtcgaagtatccggagaaacatatcttgtgaatccggcctttgatgtaatcctcgatatccaggcgctatacaaggaagaggcgctgacggacagggacaagatggagcaggcactgcagatgcttgtcgtcagcaggcgcaagttaaggaggctttcggcgcctaaaaaggcggaactgcttaatgccatatatgaccagtgcgtgaatacgcagaagaggccgccgcagaggcagaagcttccaaccctggacttcgagcatgacggggaatacatatacgcgtcattcctgctcgattacggcatcgaccttctggaagagcaggggaggcttccttggaagaaattcatcgccctgttccaggggctgtccgagaattcgaagatccgcgaggtgatgcggatccggagcatggacatcccgagatataccggaaagaacggaagggagatccagcagatccaggaactgaagtccttctatgcgcttccagtccgcggaggaggcgggcaggacgggcttgaccgtctgttcggggcgctggaaggaatggcgcagaagggaggcggagcgattgggtagcaatacaagcggcggagatgtagaatacatcgtacgggcggatgacagccgggtggagtccgatctcgagcaggccaacaagaaggttgagaaggcggtcaagaaatctgcggatgaatccatcaaggcagagcagaagaaaacggatgagattaagaaggagtccggcaagatagtagagaatgccgagctggcagcggaggatgtagccgatgcctggaaggatgccggcaaggatgcgcagaaggcgatgtccgatatcgaagtgagggatgtggatatagaagtgacggcagataccgtcgatgcggaggcggatatccacggcctggaagcggatgacatcacggcgaatgtcgatgcggacacgggcaaggctgagaccgccatcaagagcgtagcgcgcgatcagagcatagagatcgataccgatgctaatgtggcaagcgcaagatcagagatagaaagcctggcagatacggcagaagaggtgggcggcaggatcagcgatgcgctgagcagcggcggggactccagcgccctaggaaatatcggaggcgtgctgaaggattccttttccgacgcggcaaccagcgcggtgccagtgctggggaaggtaagcgagctgacatccgggctgtccggaacgcaggtggcagccctgggagtaggagccgcagccgtgggagcgggagcgatggccgtaggagccgcgaatgacatgcagggcgcgatgaacggctttctggcagagacgggcaagagcaaggaagagacggagcggtaccagtccgtcctagaggatatctacgccaataactatggagagtcgttcgaggatatcgcaggggcgatggcccaggtaacgaagaacatgggcgatatggatgacgcgagccttcagggagtgtcagaatccgcaataacgctgcgcgatacgttcggctatgacatccccgagtccaccagggcggcaaaagccatgatggatatcttcggggtatcgggcgaggacgcgatgggcatgatagccgcaggcgcccagaatgggctggactactcgggcgagctgctggacagcatatcggagtactccgtgcagttcgacaaggtagggctagatgcggacgacatgttctcaatcttccagaagggcgcagagactggagcgtttaaccttgacaaggttggagatgcggtcaaggagatgtccatccgcgtggtcgatgggtcagacacgacccgggaagggttcgagactatcgggcttaatgcggacgagatggcatcgaagttcgccgccggcggggatagcgcgaaggaggcattccagcagacgatcagcgccctggctggcatggaggatccccttgcccagaataccgccggcgtcgacctgttcggcaccatgtgggaggatctggggccggaggcagttacagcccttgcggatatacaggaaggcgcatatgatacgggggacgcgatggggcagatccaggatatcaagtatgatgacctgggatcgcagttcgaggaactcaagcgcaacgtcgagcttcttctcgtgccgatcggggaggcgctgattccgctcttctccacgctgatcgagtcggtccttcccgtcgtgaccgaactgctgggtccgctcatctccgcattctcggaactgctgggcccggtcgtgaccttgatatcctcggctgtccagccgctgatccaggcactgatcatgctcgtgacgacggcgatccagcctctgatgccggtcctgaatgcgcttatgggcgtattccaggcggtatttgacagcatcagcggcacggtgtccagcgtgatcggcaatattactaacatctttcggaatctcatagatttcgtgaacaatgtattctccgggaactggaagggggcctgggaaaacgtcaaggagatctttcggaacgcggttgacgcgcttgtgggcatattcaaggcgcctatcaacgccattgtggatggctggaacagcctggccgacagcataggcagcgtcgatgtgccagactgggtgcctattgcagggggcaagtcattcagcctgccaaagatgagccgcctcaagattggcatggactatgtgccaaatgatatgtttccggcctggctggatgagggagaggccgtgctgaccaaggaagaaaacgcgctgctaagatcttatggaggccttgaggggatggcagcgatgatcggccgatccgggcgcgatagcgtgactgtaaacgtgcagagccagtcggatatcgattacgcgaaactaggaaatgccgtggcggatgcgatgatagccgcaggggtaggattcaagtgcgagggagtcgtatttgcgcggttgatgaaggatatgattgattatgtataggatatattacgagaataacttccgtgaatccgtgtgcttcacgtcgtggccatacatggtaaccggcggggacatattcgacggaaaatgggatgagattgaaaacgaggaccatatccagggattcgagcgcaagatccaggataagacgctcgatattgagatcaaggcaataggagcagagttccggaaggccgttgacgtgatgaatgacgtgttcgagagggatatcctagcctctaagcccggaaaactgtgggttggtgacagttacatgaagtgctatataacagagtcaagcaaggatgggtgggtgagcgacatcgatatcgtcagcgacgagctgaagatcatcgcggactatccctactggatcagggaagtagagtatcccccattccgcaaggaggcctcctccgaaaagagcagcgctcttggcctggattatgaatacgagtacgagtacgaatactccggagatcagagcgtccagtatcttgtcaatgaccattatacggacagcggctttcggctgatcattaccggtccatgcattaatcccgcgatcaggataggcgggcatctctacgagctgagaacgaccctgtacgatgacgagtatgcggtaatagactccagcacaagatatacgcaggataggtctgtatacaaggttcagaaggatgggacaaaagtagacctgttcaatgcgcggaacaaggatagcgagatatggcagaagatcccgccggggaaaagcacggttacctggaatgggaacttccgcttcgacatcaccctgtttaacgaaaggggggcgccaagatggactttatagcctccgatatttacgggaatgagaacgggtacctgcgacacagcggcatagatgtcaatgtcggcacggagaatacctttgagatcaagatacagaacaagtattttgacaaggcaaggcattggtaccggtgcagggtctatgctccggggacggaatatggcggcatcgtgcgcgcggttaacccgattacggaagacgggattatcaagatcaaggggccgacttggaggggactgctaaataagaaggcaatctatccggagaaaaacgattacctcgtattgtccggagaggcgaacgccgtgcttgcagggctggtaaggaaacttggactgtcagaggtcttttccgtttcgacggagcacagcggggtgtacctggactatgtcgtcccgctgcagtccatgctgcttgatgcgattacgcgagcccttgaggcgcagggagcccgactcgatatcaagtacttttcaggggagacgcttggcagaggatacgccatgctgagcgctaagcctatacaggacctgtccgagactatagagataagcgaggacggaaatgtcaaactgaatatcctggactatcaggatggcacaaaccacctgatatgcctaggaaagggggaactggcatcaaggcagcggatagacctgtatgcctggccagacgggacaatccggaagcagcagtattatacgggcatggaggagaatgtcgagtattatgagaatacgagcgtagagactcttgccgaactggaagaggaggcaagggagaagttcgaggataagaagaactataagcagctgaagatatccgtatcgggactggatctcgaactgggcgatatcgtaggaggcagggagcgtattaccggtataacgatggcaagcccggtagtcaggaagatactgacagttacggggaagggccgcgaatcaatagactacaaacttaagggagatgattagatgattgacagcgaagtattggaggtacgagtaggagacgtccatgtgacgccggagcaggtagcagacgcgaacatcggcacatttgggccagatgactatgtgctcagcaccggccggaaattggaggcgcaggtcgtcaccaataactccgtgcgtgtatttgacggcgtaatggtgtatggcggcatacgagacgtcatatccgtcaacaagtattatgacatccagattgacaatggcgcgcagggcatgaaccgcaatgacataatcgtaaggcatttcgcgatcacggacgaggtaaccaagagaggcggggcgactttccgggttatcaagggtacgccatcggagggagaggcagcggatccggagatagcgatcacggatctgcgtgccggggcattatcgcacgacatgatcctgcatcgggtacgtatagaagggctcaatatagttgccgtagagcctatgtatgatgtcttgtacaatgcagccgaactgaaggaagaagttactgaactaaatagaaattttaaagaatccgtgtatgcggatggctacatggttgttgatataggtgcattgccaaacaactcaacaaaatcagtccctacaaatattccgtctgcatctgaatactggatatcagatgcctggtgcaaaagcaggacaacagggcaagtcagccctatgccatacatagatgcaagtacgtggagtaatgcgatcggaattactatatcagccagtaaaaatattgtcgtgaccacaaaagcagactggtcagcgtattctggcaaggctgtaatagcctataaactatagattggtataatatgtaaaattcacagcagcgtaggtaaccgcgaaaccatacccagacagggtaagattatttgacaatccgattgccgtgaatcttgtgacatctatcgccgtgtatgggaaatcaaatgacgtacttgtaccattaattagtacaagcccctggacagttaccctgcgcccctcacgatataccttaagattcgacgatatgtctgttttgacatatgccaattttctatttagttaacgaaaaggaacccgttaatcagagccaaatggctcttttttgatgtgcgacgtcgcacgaaaggaagtgaaattttgaaagcaatatttaatgatgctaccgctatgcaaatcttaaaatttgaagtttcaggcggcaaattaagtatcaaaacaatttacgccactcgcgaagaacttcgagccaagttttcggatgagtttgcgtgtaaaaaaatagtaatcgaagaacggggacagacaatagcaacacatatcgattatacaacgctatatcggatagaagagtatacaggaggaatccttggcgtggtcatgtaccaggatgagaagactcccgaggtacaagcagaagtgcaggccgccgctgttatggtagcacagatccaggctcaggctctggtggacgagcaggcactggccgtgcaggcaatatacccgtcatggaacggagccagcgtggactatgcagagggatataaggtgcgacataatgggacgctgtacaagtgcctacaggcccataagagccaggcaggatgggagccgggcgttgcgccaagcctatgggtatcgatagccggagagcaggcggggacgattgacaacccaatcgcagtaccggacatggttaccgtgtccggaatggaatacgagtgcggcaagtactacagtgagtcggggattacatacctgatggacaggcaagggatgtctatcggagacacggttatcctgtatttccctccaagtcaattggtgggacaatattttacgattattgaataaggaaggaaagtgaggtatatgaaattgaaaacaggcatttgtgctattataggaacagcgggcagcgtagtggctgccctttttggcggatgggatgcggcattgcagacgctgctcatatttatggggattgatttcgctatggggcttatcttggccggagtattccggaagtcagggaagagcgagagcggagcattagaaagccgggccggatggaagggactatgccgaaaaggagtaacgcttctgttcgtgctgatcggtgccaggctggatgttattattgggactaattatattcgtgacgctatatgcattggttttattgcaaacgaattaatcagcattgtggaaaacgcagggctgatggggatcccgctaccggcgattgtgcagaaggcaatcgatatattgacagataaggcagagggcgagtgattgccctctttttaggtgacgttgcacagagaagggagagcgaagaatatggatataatcaagcatgggttaaggttccggggcaactttacttaccggaataggacggatgagatcatctggcatcatgcggaggcgaactgcacggtcgaggacatccattcctggcacctgaacaatggttggatcggatgtgggtacaacctgataatctacaaggatgggacggtgcacgagggaaggccgctgaatgccgtcggagcccacgcatcaggccacaatagccgcagcgtgggcgtctgctgcatcgggcgatatgatattgagaccatgccgcaggcgcagctggatgcggcaagacaggtgcaggcttatttaaagggcctgtatccaggggcggaaacgaagaggcacaaggatgtaaatgccacctcctgcccgggcaagaacttcccattttcagagatcgcgggaaccccaggggatgcgtccgccgaggcatccacagtaggccaggggataagcccttccggcaactggtatgcgcgcctgcagacggagtgcaatgcgcagggattcagcagacagaaggtggatggccttcccgggccgaatactctggcgggatgcccgacgcttgggcggacgagccggggcaagattacggccctgatgcaggagaggctgatcgcgcttggctattcctgcgggccttgcggggcggatggcatcaatggcgcgggaacccaggcggcgatcaaggcattccagcgtgatcatggacttgccgtggacggaatcgtcggacagaaaacctggagcaagctgctgggtttatcttaataatatcatcactaaggccccggggcgtcagaactccgtggcctatttcgtgtgatatttcatgttgcatagaattgtttttgagtgaaaaaacatacatacgtttggaaaatcccttcatttaaaagcaataaatttcattgtggttgacacactttagggcaaagccagagaaataggagattaatgaagaatggccttaaactgttcaactcccgccaggtccactaaaaaaacgccgtagttacggcgtgcataaagaaaacaaagtagcggcgaagttatccagacttcgccgctacttttgtataggctatgcttctccttgcatagtttccgttccaataatcacgtgaacgcccaccttttttaaatgatcaatatacttctggtctaatgaggaatccgagatcaagtaagagatttcttcaagacctattatcttttcaataaaaggcttcacacggaattttgtggagtccgccaatatataacattttttcccacagtggcacaatgcccgctcagatcttggatcaaggtctatcgaagtgatcccaaaatccaaatcaatagaatccacgctgcagtaggatctgtctactcttaggctggtgagaaagtcttcggcggttggacccagacaggcgccgtttctatgctggacttctccgccacatatatataaccggatattgcggtcaaatactagttcataggcgatgggaacagaatcggtcactactgtcagattctttttattgtggagcatggtagccagcaaaaaggtggttgtgccactgctgagcgcgataaaatccccatccttaatcgtatccgctgcggcctgggcaatctgcattttcttttccagatttgtgatgccgccataaaaattttcgttgtttggaggctgtggatggtcaatctttaccgcgccgccatgagtccgaagaagcatgcctttgtcgttcattttctggagctgcagacgggcagttgatgaagatatgcctaatgcttcggtaatctcatcgacagtgatcctcccattttgctgtaaaagttccataatgacatgttcccgctcttctgaaaagcggccgtttgatgtccttgacaatcgtttttcctccttttccattatttgatactattataattcattacgcattccaaaacaagtggttaaaggaagatttgtaaaaaaaattggcgaaaacgatgataaacaatgattgtagcagtcaatatacacaaaaacgatgaatattatttgataaaatccaacaaaattgattgatataacaaaaaacgattgaaaacaattagaaaaagcgctaatattgaattagaaaatgaaaggaaggagaaacaagtatggatacaaaaatagtaaagccttcagaagccaatatttttttagaaggagtggaggtatgccgggaatattttcacacagaaaaaattacttttggcacatctgaactgcagcctggacagacgggagcggttgacaatgggcacaaggattcgcacgaagtattttatgtggcaaagggccatgtactcctcagatgcggggataagctttacgatctcagagaaggcgatgctcagattatccctcctggcgagcctcaccagttgacgaatatcggaacagaggcttgtgttgttacctggagtttggctccatctgaatcatagaaagaaggtagaaaatgaaaccagaaatgattataatgttaaccaacaacgatatcacggtacccgatgcagaggaaatttttgaagaatgtaaagaccttcctgcaaaaaagtggggatttaaggatgttggcctggaaaaggataggatgatagaacttgcaaaaaaaatgaaagatgcaggtaaagaaacatacatagaagtagttacctatacagaagaagggtgtctagaaggtgcaaaacttgcatacgaatgcggattcgactatctgaccgggactttgccatttgactctgtgcttgaatacgctaaggcgcataatttgaaatactatccatttgcaggagatgtggggggcagcccggtagaactgaaaggctccatcgagtcggtgacggcctcggcaaaaaaagccatcgaatccggagcagccggtgtagacctcactgcataccgctatgcggacggcgacccaatcgagcttataaaagcagttgttgatgcagtcggcgcggataaggtgtgcatagcgggcagcataggcaatgccgagcgtatggaagccatgaaaaaagctggcgttgccgagtatactatgggaagcgcgctgtttaatggtaattttgtaaaaggcggtacgttccgtgaaaatctggaatacgtacttgattacctcaaggaataacaatgaatcaaaagcggaatatccgctcgtattaagaaaggaggagggtacatgagttatattcttggtatagaccttggaacaacggcaattaaggcagcagtatttgatgacaaggggaaggaatgcggttccaagactgtagagtatactcctgatacgccgcatcctggctatgcagaattggatgcgcaagtatatgtagatacgtttatctccgctgcaaaatcagcaatggagagggcagcagtcactccagatgagattgtgtcgctggggatgtctgcccagggggagacgaccatctgcctggatgaaaataatcatccgctccggccagccattgtatggctggacatccgggcaaccaaagaggccgagtatattgagaagacgattggccgaaaaaagatccaggagcataccggtcagcccggcatggacgcgatctggcctgcagcaaaaattctgtggcttaaaaagaatgagcctgagacatatgaaaagacatgtaaatatgtacagttaaaaggctattttagttatctcctaaccggaagaatggcctgcgaggattcgattctgtgtacgactatgtattgggatattaatactcggaaatactggccggaaatgatggacttattaggaatcaatgaaagccagttgccggaagtcttaaaacagggcgagtgtgtgggacagattacgccaaaaggcgctgccatgttcggactgagtacaaaaacaaccgtcaatattggggcgctcgaccaggcatgtggcgctctgggcgttggaaacgtaaggccaggaacattttccgactgcacaggttctaatttatccacagtggctatcgtagataaacttacactggatccttccatgcagatgccttgttttgcaagtgctattccggggaaatacatgcttcatgcattttcaagcggaggaatggttttgaaatggttccgggatatcttttgcgagattgaaaaaaatatcgaggcagggggtggagaggccgcatttgatcagataggaaaagaagtggagaagatcgccccgggaagtgacgggctgattatgatcccgcatcttcaaggttcagggccgccggatacggataataatcagaaaggcgtatattttggcattacgctggctcatggaaaagcgcattttgcccgtgcactgatggagagtattgcgatggtcttaaggagaatgattgaggcaatggagccattaggtgttgaggtaagacagatcattgccttgggcggaggctccaaaagcgatgtatggtgtcagatgaaagcagatgccacaggcgtaccaattagtatcatgtccacaacggaaagttctgcgtgtcttggggcggcaattcttgcgggagtggcatccggcatatggacgtctccggaagaggcggcggatgctattgtgaaggcggatgcttcttttgccccaaatgaaaatgtaaaagaagcatatgacaaattgtttgaaaagacgatgaaactgcagaatggattgaaggtattttatgaagacagcagtttccggtagtgagaatatagacagttttgagaaagtatagaaaaagtgccaggtaattaaaaaataaaaagaaatgataaggagaaatgaaaatgaataagtttgcacacgtatatccagcaatggtgacaccatttaatgaagatggaagttttaactttgaaaccgcaaaaaagcatgcagactggatgatcagccagggcatcgacggcgtgggcgtactgatggcagccggcgaataccagagcgtgaccttggaggaacataaaacgtatgtccgcgagatggtgccatatgtaaaaggaaaaggggcatctgttatcgttggcgcttccagggaacgcgtggaggatgttgttgaacttatggagaatgcccgtgaagcaggagcggatgctgccatggtgcttccttctttctactaccgaatggatcagaaagaaatatataaacactatgaatatatcaatgaccattccgggctggatattatggtatataacaatccgcattgcagcagccctatcgctactgagaccatgaaggaactgtacaaactggatcatgtgaaaattgtcaaagatgcatctatgacgattgatgttatgacagactacatatttgaggctgagaaagcagagggagagaaggcggtactttgcggatgcgactatctgctgtatcaggcttatgcgactggcgcgatcggatggattagtatgaccgctaatattcttccaaaattatccgcagaattccacaaggcaatgattgtggagaaagatttcgcaaaggggctggaactttataaaaaactctatccggtagtaaatatgacggaaaggttcccgaaaccgacccaggcagtgaaatatatcctggaggaagtgtatggatttgaggaaggaatctgcagacgtccacgctatggattaagtgatgaggagaaaaaacttgtgcttgactggagcgacattgtggcactgtctaaggagtaaaaggaggagtttcttgtgaaatacacagaatatttgattatcggcgcagggattgttgggtgcagcacggcatatttcctggcaaaagagaataaaaaggtgatgattgttgacaggacctatccctgcaacgaggcatcaggggtaaatgcaggcgggctggaacttctccagcagccgccaagatccctgcctttacataaattatctgcagaactttggaataagtttcaaaatgaagaagggatagacgttgggtatcatcggaccgggggactgtactgcatccttagggaagaagaccttcatcttttagatgagcaggaagagagatttgaaaagaatggccttcctgtacaacgtctgaataaagaagaagtttctgcgaaagtaccatatatttgtgacaatgtgattgcagcaaacttcagcccgatgtccggatactccaatccattaaaggcaggagtaagcatactcatggcggctaaaaaacttggggccgaattttttgatcatcagattattacaaagatagagcctgccgctgatggaaaaggatatatggcctattctgaaaatgaggttttccaggcaaataagatattggttgcatgtggcatccgttcgccacgacttctagatcctctgggcgtgcatatcgaacttgaagaaaagcataatatgataaccgttacagaaaaggcgccgcattttgttgattatacgataacaactccaacaatgactatgaaacagacggcagaaggctccttcttaatcggagggggaagagaaggatatggcgacctggcaacaagtgacagaaaagatgtatctatcaatggcttgtgcttcaatgtaagggaggcacaggatatcatcccttcgctaaaaaaacttaatatcctgcgtagttggtcagggtttgagggattcacgccggagaggcttccctatataggagaggtagaaaaatatccgggaatctattacgcggtcacaggtttctgcggatatgcgataggacctgcagtagcggcgcatgcgattcagtgtatgaatggagaagaatattttaaagttcatggatagagatatggattagttgggaggatacgaaatgtccagaatagaaaatcatattattttgggtgatctggaaaaaggaaaagaagtccagattacagtagacggaaagaagatttccgcaaaggagggcgagccgattttatcagctcttctggcaaatggcattaaggttcagaatatcagtgccaagaaacacgaacctagagggtatttttgcggcattggccgatgcacgaactgcgttatgacagtaaacggagatccgaatgtgcgtacctgtatcacccctgtggaagatggaatggttgtagagacacaggacggccttggaaaatgggaggagtcaaaatgaaagatgtttttgatatattgattattggcgcaggaccggcagggctttctgctgctatagaagcagcaaaatacggcgcggaagtgctggtggttgatgaaaacagcaagccaggcggacagctgtttaagcagatacataagtttttcggctccagacgacacaaagcaggggtcagaggtatagatataggtacagaactattagaggaagtggaaaaactgggagtggaggtaatgctggacacggtggcttacggcatttatcccaatgatgaaggggtggctcttgctgtaaacggtgaaaagggtatgatcgtacacccgaaaaaagtaatcatggctaccggggcatccgaaaatccccttgcttttccgggatggacgcttccgggagtagtaggggcaggcgcaatccagactatgattaacgtgcatagagttccggtaggcagcaaggttctgatgattggatcgggtaatgtaggactgattgttacctatcagcttctccagtcaggtgccgatgtggctgggattgtggaagcagcgcctacagtgggcggttacggagtacattctgcaaaggttagaagagctggagtaccgatgtacacaggccatactgtgctaaaagctgtgccgaatgaagatttaagcggggtaaaaggggcgattattgccgaagtggatgaaaaattccagcccatcaaaggtacggaacagtttatagaatgtgacaccattggaatcgcagttggactgacgccggatatcggacttccgtctatggcggatgttacatttattaatgccggaagactgggcgcgcaagtccccatgcatgatagagatatgatgacaacgaaagatggcatctatgtagcaggtgattcggcgggcgtggaagaggcttcctctgcaattgaagaaggcaagcttgcaggaattgcagcggctgcagcccttggaaaaattgatgaggaaaccgccagagaagcaaaggcaaatgtatggaattctctaaatcagctcaggactggtccttttggttctggacgtgcagaggcgaaggaagaaatcataagagagatggacgaatggaaggtgagaaataatgcttgctaaagatgggtttttagatattgaagaaatcaaagatattcccggattcccagggcaggaagtcctgaccaggaaaaaatgcgtagtaatagaatgtcagcagaacataccatgcaatccatgtgaagcagcctgtcctcacaatgcgattacggtgggagagccaattacgaacctgcctgtaattgatgcggaaaaatgcattggctgcggactgtgcgtagccaaatgcccgggccaggccattttcctggtggatttgagccaggaggattttgatacagtgacgattccgtatgagtactatccattaccggaaaaagggcaggaagtatactgcttaagcagggcaggagaattcctgacaatgggcaatgtagtacgtgttgttatgacaaaagcgaatgatagaactgctgtagtggaaataaaggttccaaaaggatatgggatggatgtacggggcctgtctactgacaaaaaaaggatggctgcaaccagcgagccaaataagacggcagagaagcttcaggaggaaataaatgaagatgacatgtatgtttgccgctgcgaggagattacaaaggccgaagtaatagaagcggtcagaaatggcgcgaccagtgtaaatgaagtgaagcgtctgctcagagccggaatggggctctgccagggacgcaattgcgcaaagacaattgaacggatcattgcgcaggaactgcatgtttcaccggcacaggtcccgcaggcaacgaaaagaggacctgtccgaccgataaaactatctaattacacatctctggatatcgaggctgacgaggaattctttgaacatgattggtagaaatcattaaaaacaaaggagagatgtgtaaatatgttagaaacttttaataaaatggtagaacctgtcaacagcctgatctggtcaaacccaattgtattcctgattcttgggtcagcaatctggtttaccatcagaatgcatttcgtgcaggtcagaaatctaaagcaccagttctccctgctttttaagaagaatgaatctttggaaggcatatcaccctttgaagcattctgtactgtagtggggtatcgtgtaggtaccgcgaatatcgccggcgttgccgttgctgtatttagcggcggccctggggctgttctatggatgctgataacatctatccttgacgcggctatatcctatgcggaatgcgcgcttggccaagtatataagataaagcaggatggcgaataccgtggtggggcttattactatattgaaagaggcatgggcctaaaaggcacggcaatcatatatgcgctccttacgttgatctgcgtaccgatccttacggtggcgcctcatgcaaactctatctcgaaagcattcaataacagtatcgggcttccgctgtgggtatcaggcattgtagtgggtatattcttattgtggacggttttcggcggtattaagagaatcgcaagaattaatacttaccttgtaccggttatgactgggctctatctattaatgacggttatagttctcgtagcggatgtaaagcatataccagctgctatcggaacaatcgtatccagtgcgttcggcactgacgccatcttcggcggattattagggacggcagttctttggggagttaaaagaagcgtgaattcgagcggggcaggtatgggcgaggcggttccggccgcagcggcaacggactgcaaacatcccggaagtgttggcctcgtaaattcattcagcgttttcattgatgtaatagtctgcatctgtacaggtattatgattgtccttacagactgcttcaatgtaaaggatgctgctggaaagatcctgcacttgggaaaaggatcagcggtaatggcccagcaggcagcagatggcgaggcaggcattgtatgggcgcaggaggcaattggcacggttcttcctacaatcggcggtcttgtacttgcgttctgcctattgttcttcgcatttacgactgtcctgaattactattaccagggcgagacttcgctggcgtttattttcaggaacagtaagcagtctatccgtaagacagctattcttattttgagaattctgatgccaatatgcttcttcatctttgcaatccaaagttcaggcgcgagttttgccattggcgaagtcggagtaggcatcatggtgtggtttaacgttattatacttttaatcaacaccaaaaaaatcattgctatttataaggactatactgctcagttaaagtcaggaatagatgctcctatttttaatccagagaaacttggcatcaaaaatgcggatttatggatggaaataaatgctaaggaaatcgctgaacagaatcagagcaaggaataatatgattttagagattgcgaaaggggaaggagtatgactaaactatccagtatgatagacacgtttcaattatgtaatgggtataggataccctgcatagggtatggaacctggcaggcacctgatggagagactacggtaaagtctgtaaaggaagctgtaaaggttggatatcgtcatattgatactgctgcttgctatgggaatgaaaaaagtgtaggacagggaatccgggagtcaggaattgaccgtagtcagttatttatcaccagcaaggtatggaatacagaaagaggttatgagacgaccttagctgcttttgaaaaatcactgaaagatctaggtgttgactatcttgatttgtatctgatacactggccggcttcgccttcgcagtttgacgattgggagaaaataaatgtggagacatggcgtgctatgatacaaatgtataaagcgaaaaaggttcgagccataggagtttcaaattttatgaagcatcatctaagggcattgctggagatggaagtaaagcctatggtaaatcagatagaatttcatccgggacagatgcagcgggagacagtggattattgcagggctaacggcatgctgattgaagggtttagtccgttaggaacgggaaagatgctcagtaatcccgatttaatggaaatagctgaaaaatatggtcggtctacagctcaactgtgtatccgttgggcactgcaaaatggagtgcttcctctgccgaaatcagtgactccggtaaggattgcggaaaattcccaggtgtttgattttgaaattgccgaagcagatatggaatatattaataatatgccatatataggcggttcaggcaatcatccggacaaggtaatgttttagaagggaaaggcctttagttgtagagcggtatggacaaaatagaaagtaggtgctggagcgttagttccagcacctttttttaaatctgtgccaggaaatcgctaaagatcttgcaatgcagttcctcatcaagcgacagcctggcaagcatcttcgatacaagcggatccttgatttcttgtgcctggtctgcatacgccttagcggcaaatcgttcggactcggcatttattgatagcagcgtccgaacgtcgcagctatagtttaccatatcgccgcaccagtacgattcaggttctgaagagcggcattccggctgggccccaagcagggtgatgagttggccgagtatggagaaatgatgctgttccactacggccatccgttggatcagccgccggatgccttgataatcgttgctgatcgtccaggactggaacaggtattggtgcacggtcgtcatctcgctggcagcagaggcaaagtcaggcataagaatatgcgcataacgcaggttcttttccgagacagcgacgttaggataccaattggagtgaatgactggaatagagttgggatttgcgtggatattgtatcgaatattgctcataatacatcctcctaaaaatctattgatataattaccactttatgaaatatggcgtgagtatagaaccggccggccaacaccataagaaaaggcgtaagagggctttgggttgaagaatgtcggaatatgggtgtaacattatagatattgatacgttaatagtacaaagggggtggcagagtggataatgatattctggaacagatttatcatagatatgccgggcaagtctacttgtatcttttttcgctctgccacagccatgcgctggcagaagatctgatgcaggagacatttctgaaagccttatgttcaatggaactgtcacaggatgcagtgcttccctggctcttgagggtggcaaaaaatctgtatatcgatgcatggcgaaggcagaggcatcatacagaagcaaagaaagaacagaagtcgtccgaagaagaactcttaaactgcctgatacacaaggagcagaacagacgactctatcaggcgatacaggcgcttaaggcacctgagcgggaggcagtcgtgctgtattactttgcggggctttcccaggcagatatcgcaaggcagctgggaatgagtcatggaaatgtgcgggtcatgctgcaccgtgcgaaacagagactaaggaacctattagaggattgataaagaaggtgggcctatgaagtacgaagaaagatttcaaagatatctgaacggagacgcagatgaacatgagagtgtccagatagaagaagacctggaaaaaatgcggatattgtcatcctatcttgacagcaggctggatgcccaactgttcgcggaggaagaaggaggagaccaggcaggcaaagatgacgggctgagccggcaggtatccagggcggtagggcggaagcttaggagatatgcgatagccgccagcattattatcgtgctggtcatcgtgcctctcatcatttatggcctatcgcccctgatggacagagtattctataatccatcaaaacaagtgacggtggaggcgcctgatggtaacagcgcggtagtctattccgtatttccgctagcaatgagaacctatatggaattgttctgtgcagataagggaagggctgatgtagcagtccggccggaagggtatggacgatattcgctggatgtacggacccaggtcaatggagagattacccatcattctctggaactgacgagaaatcatctgtatcgattggatatgaactggaatcagccagatgttccgggaaacgcgtttacttactgtgtggaggaggaagagatgtactgcggggacagtctggaggaaacggcaagcaaattgaaagatgtgccggaggcattgaagatccgcgcggcagtttcctttaagaagccgaaaaacgcagaagaattgtccgcatttatgaaagcctacgattcccaatatctttctattccatttatatcctgtgagaaacaggaagggatcatgacggatggctttggattctgtccggagattatcggtacggatcttacagattgttatgatcaggcgaaatatccatatcttgggcttgaagagtatcaggaaggagagattccggcagaagtctatacgagtcatgtggaatcgatgcttcaatacatgcttgacagtcctgacttcttgagaatctttgattcgggggcgcccggggtcaatctgctgaatgatgcgaagtacaagacggctcttgcatatgtcagggagcatggggtgtacggatatggggctgttgtcaatgcgacgaagcaggaacttctggctatgcttgaggatccatctgtagacggcgcatatatgatggacagttttctggatcttaggttctgacggtgcggcgattacatttagattggaattttatgggattcagggtatactatagataggaacaataaacggtgtagcaggattgaggaagggagtgggcagtatgacagaaaatgtaattattacgattggacgccagtacggaagcggaggacgggagattggaatccggcttgccaagaaactggagattcctctctacgaccacaatctggtggcaatggcggcaaaagagctgggtatcagcgagaaggaagccaaagaagcggatgagacggcgctggaaggatttctgtcatcctatattgtaggccctggcgactatgcagtctatatgaatgcagaagacgacatgcgccccttgacagaccgggtttatcgggcccagtctgagatcataaagaggctggcagatagaagcccttgcgtcatcgtcggacggtgtgcggattatatcttaagtgactgccccaaatgcatcagcgtatttatctgcgcggataaagaagacagaatccacagaatagcggccctcagagatctgcctgagagaaaggcggcagagaagattaagaaggttgacagggagagaagatattattacgagtccaataccggagaagagtggggcaaatcgggaacataccaggtgatattgaatgtaagccggaccggtatcgaaaaagcagtggatatgctggctgccctgtttaatgggctatgtgattagaagatataaaatggcgcctgccgcttgcttaaggcggatgtcatgcaaaaaggaactgctgcttattctgcggcagttccttttgcagttgtgaatggaatgctaaccaaaaagtttcttatcgaactccggatttgcataataataattctttgcatccagtttgtctttggtcttttccaatgcttctccgaaacgctggaagtgaaccacctctcttgcgcgtaagaaccggatgggatctttgatctccgggtcatcaacgactcttaagatgttgtcataagtggtccttgccttctgctcggcagccaggtcttcgaacaagtcagtgattgcatcgcctttggattggaattcacaggcattaaatggaattccgcctgcagcctgcggccataatccggaagtgtggtcgatgtaataagcatcaaatccagctgtctttgcatcttccggagacatatccttggtcagctgatagatgatcgcgcagacaatctccagatgtgccagttcctccgtaccaatatcggtcagaagtccggctacttccttgcatggcatggtgtaacgttgggaaagatatctcatagaggcggccaattcgccgtcaggcccgccaaactggctgatgatcaattgtgctgtcttagggcaggtctttgatatcttaaccgggtattgcagtcgtttttcataagtccacattaaatatgccctccttcccaaggagtcggcccttccgcccaggaatgatattcacatgagcagtccagagtcagaggtccgaattccttcgcgtatttctgcatcagttccttcctcttggatgcggcctgctggaaatcagacttggcgattgaatccatcggatgggtatccagatacagggtcagatcattgaatacgaagctgatctcgttgatcttctgcagtaatgcatgtctatcttccatcagtgccacctcccataaagaaaggaaggtccagttccttgaagaccgttcctcttgctaaagcctcttcaggttcatacagctgtccatatatctgcatgggaatagcagccattgccaggacgcaagtacattcctgacgggtgttctgctggtttttgtccatatagatcgactcctttctagccaaagtggcttgtatattgctatacactactattatccccgacgcaaggcatgatttatgttataatataaatggtaatttcacaaagacgacatatttctttggtatgatttaagaaaagtattggaacatctttggatggaggttatgtcatatggaaaaaattaaaattttgatcgtagatgatgagagcaggatgcgcaagctggtaaaagatttccttgggcgggaaggctatctcgtccgggaggcgggagatggcatggaggccttggaaatcttctacgaggagaaggatattgcgctgatcatcctggatgtcatgatgccaaggatggacggatggcagacttgcagggagatccggcagtcttcccaagtgccgatcatcatgctgacggccagatcagaggagcatgacgaattgcaaggattcgagctgggtgtggatgaatatatctctaagcctttcagcccgaagattctggttgccagggtagaagcaatcctaaggaggtcccacgcgattggaaccggggatgtgatcgatgcgggtggaatcatgatagacaaggcggcccatcaggttaagattgacgacacagagattgatttaagttttaaagaattcgagcttctggcctactttgtggaaaaccagggaatcgccctgtcccgggagaagatattgaacaatgtgtggaattatgactatttcggggatgcaaggacgatcgacacccatgtgaagaagttaagaagcaagctgggcgacaagggaaactatatcaagacaatctggggcatgggctataaattcgaggtagaggcatgatgaagcattcaatcaagcggcagatgatcacggtctttataggcctgctggcatccatggtcctgctgcttctgatcattaacgtcagttttctggaaccatattatatcagcaacaaagagacgcaatttatagatatgtatgaaaaactaagccagtgtatggacaaaggcacgatggaggacaaggaagtgtctgtgaaaatgatccatttggcggagaagaataatatctcattcctgatcgtaaatgatgccacaggaaaaggatataccaatgtctatgactcggatatgctggtaaaccagctgcgaggatattcgctgaaccaggcgcagaaggggagcaagattctggaaagcacaaaggagtatcagatcagccagtctttcgacccgtggaaccagacggactatatagagatgtggggaagttttgacgacggaagcagattcctgctgcgcagcccgctggaaagcatcaaagaaagcgccgccgtctccaaccggttcctgatctatattggcagccttctgattctgatatccgtggttcttgtatggtacttttcaaagcggcttacagatccgattctggaactggcggtcctgtccgagaagatggcagatctggattttgacgccaagtatgccagtggaggcagcaatgagattggggaattaggagccaattttaacagaatgtcagagcggcttgagagcacgatatctgaactgaaaaaggcaaataaccgtttgctggaagatattgagcagaaggacaaactggagaagatgcgtaacgagttcctgggaaatgtctcccatgaattaaagacgcctatcgccctgatccagggatatgcggaaggactgaaggaaggagtcaatgaagacgcggcaggcagggaattctactgcgacgtcatcatggatgaggcagccaagatgaaccagatggtaaagaatctgctgacgctgaaccagctggagtttggcgacgaagacatcgtgttcgagcggtttaacctgacggaacttgtaagaggcgtgattcagagtatggagatccttgcccagcaggcggaggcgaaggtcatcttccgacagcaggagccagtatatgtgtgggcggatgaattcaaggcagagcaggtggtgcgcaactatatgagcaatgccttccatcatgtgggaggggagaaggtagtagaggtcaagatcctctcggatggagagaaggcaagagtgagcgtatttaatacaggagctccgatcccggaggaagatgtggcgcatatctgggacaagttttataaagtagataaggcgcataccagggaatatggggggaatggcatcggcttgtcaatcgtaaaggcaattatggagtctcttcatcagaagtatggattgaataattatgacaatggtgttgaattctggttcgaacttgatgtaaaataaaacgatacactataccgtaccaaagaaaggcaggtcagtacattgatagcaataatagattatgatgccggcaatattaagagcgtggaaaaagcgctgcagcttttgaaccaggaagtagtcatcaccagggacagggatgcgattttaaaggcagacaaggtaattcttccgggagtgggctcctttggagacgcgatggggaaactgcgccagtatgggctggtggaagtgatagaggaagtagtaaggcgcgggacgccgtttctcggcatctgcctggggctccagctgttatttgagagaagcgacgaggcgccgcagatagaaggccttggcattctgaagggggagattcttcgcattccggatggcgatgggcttaagattccgcatatgggatggaattccctgagattcccgaatcagggaaggctattcaaaggcctgaccgaagagccgtacgtatatttcgtacattcttactatcttaaggcaaaagaggaggagatcgtgacggctaccaccgagtatggaactttgattcacgcttctgtggagaagggcaatatattcgcctgccagttccatccggagaaaagcagcgatacaggaatccagatacttaagaattttgtggaactatagacggaggagagagtatgcatacaaaaagaatcattccctgcctggacgtgaataacggacgcgtagtaaagggcgtaaattttgtggatttgaaggatgccggagacccggtggagattggaaaagcctatgataaggcgggggcggatgaactggtatttttggatatcacggcaacttccgatgcaaggggaacggtcgtggacatggtacgcaaagtggcggagacggtgtttataccttttaccgtaggagggggaatccgtacggtcgaggatttcaagatgctgctcagggaaggagcagataagatttctatcaattcttcagccatcaatactccaaggcttatctcggacgcggcagacaagttcggcagccagtgcgtggtggtggcgatcgatgccaagaaaagacccgataacagcggctggaacatctataaaaatgggggacgtattgatgtgggcatcgatgcgctggaatgggcaaggaaggtcgagagcctgggagccggagagattcttcttaccagtatggactgtgacgggactaaggctggatacgatctggaactgaccagagccattgccgaggcggtttccatcccggttatcgcgtccggcggcgcaggaaccatggaacacttttatgaggctctgacgcaagggaaagcagatgcggctcttgccgcttccctgttccattataaagaactggagatccgggaggtgaaagaatatctgcggaataagggcgtatccgtacgcctgtagcatggaaggaattagaatatggcagcgattaataatgactggctcgaggctctgaatgatgagtttaagaagccgtattacaagaagttatttgcgacagtaaaccaggagtataagaccaggctgattttcccgccggcagacgatgtcttcaatgcatttcatctgacgccgctacataaagtaaaggtagtgattctgggacaggatccctaccataacaatggacaggcccatgggctgtgcttttccgtgaaaaaaggtgtggagaccccgccatccctggtgaatatctatcaggaacttcatgatgatcttggatgcgccatcccagaacatggatgcctgacgaagtgggccgagcagggcgtccttatgctgaatacggtgctgaccgtacgcgcccatcaggccaattcacacaggggaatcggctgggaagaatttacagatgccgcgatcatggctttaaatggccaggacaggcctatcgtatttattctatgggggagcccggctcagcagaaggcaagaatgcttaataatccgaaacatttgatcctaaaagcgccccatccaagcccattatccgcattcagaggattctttggaagcaggccattcagcaagaccaacgcattccttgaagaacatgggatagaaccaattgactggcagattgattagtaaaaagggaggtatgtcatgggaaagcaatttgatctgatcattatcggagccggcccaggcgggtatgttgccgcgaagaaggcggcgaagcttggaatgtcggtagtaattattgacaaaggggatgtggggggaacctgtatcaacagaggatgcattcccacgaaagccctggtgcacgcggcgatgctgtaccgggagatgacagaatgcgaaaagttcgggctgtcagcagaaaaggtcgggttcgacctgcagaagatatatgagtataaggatctttccgcggcccggatgcggaaggaactggaaaaagagtttaaagagcttggggtagtcagcgtaaggggaaccgcaacgatccagagcgacaaaaaggtcagggtagttacgccgaataaggaagaagagtactattatggcaagcatatcctgattgctaccggggctagggcccgcacgatcgatattccgggtctggaccttcccggagtcatgaccagcgaagaattgctgacgtccaatgagagtcagtatcgcaggctgctgatactgggcggaggcgttatcggaatcgagctggcgaccgtattcaatgcgcttggaagcgatgtgacgatcgtagaagtatcagacaggctgcttcccaatatggacagcgaattttcatctgctttggaggaaatccttacgaaccgcggaatcagcatttatagggaaagcatactggaaagagtgacgcagcaggaggatggcgtaggatgccatttcgtgtataagggggaaaatcagcaggttgatgtggatgctgtcctggtatccgtaggaagggttgcgaatacggaagggctcttcgatccggatgtccgcgtcaagatggagaatggaaggattatcgtagatgatttttacatgaccaatattccggggatctatgccatcggcgatgtcaccggaggaatccagctggcccatgtggcttcggctcaggcaacctatgtagtggaacggatgaacgatgtagagccgtccgttattatcgagatggtacctagctgcctgtttacctctatttctatcgtgcccagctgtctgtatacggatccggagatcgcgtctgtggggattacggaagaagaggcccggagaaaggggatttctctacgctgtggcaaatatatcatgaatgtaaatggacagtctattatttccaaggaagagcagggattcataaaagtactgttcgcagccgacagcgatgtgcttttgggcgcccagctgatgtgccagagggcgaccgacatgattggagaattggctacggccatagcgaacggcctgacttcttcccagttaatgtatgcgatgcgcgcccatccgacgttcaacgaggccatttcctgcgcagttgagaacagcagggagcaggctcccagatggtaacggacttgggacggggtccgttttaatagcgtttttaagattggcgccatggatgaaaatccatggtgctttttcatttcttttttcaagattatatattgacaatccataacggagtgcatataatataaatgaacatatgaataactgttcatatgttcaggcgaaatcacaacattcattcaggaggatttgagatatgaaagaagcagaaagagtgagggtagcacatgagcacgaagcgtgtggatgcggccacgaccatcatcatgagcacgtgcatgaagagcatgagcaccatcatcatgagcacgaagcgtgtggatgcggccatgagcaccatcatgaacatgggcatgaagagcatgaacaccatcaccatgagcatgaagcagcggcatcccgggagacgcttccaatgccggagggtgttgaaaagagagtgtatatacttgagaatctgggctgtgccaactgtgccgccaagatggagcgcatgatcggggaacttccaggggtaaagatggctaccattacatatgccacaaagcagctggcagtagcggcagaccaccaggaggcattgcttccggaattcagaaggatatgcgcatccatcgaggaggatgttacggtaacgcccagggacagcgcaccagtaaaaaagcaggaaaagaccagcactgtccaggataaaaaggcggatatcctggccatagccgtgggggcggtgatgtttgtggctggagaggtgatcgagcatctttatccggcatctttgattagcacggtactgtttatagcggcatatgtgattctgggtcttggcattgtgtggacggcagttaagaatctggcaaaggggcatgtgtttgatgagaattttctaatgagcgtggcaacgctggcggcatttgccattggtgactttgcggaagcggtaggcgtcatgctgttctaccgggttggagaattgtttgaagacattgcagtaagccgcagcagatcccagatcatggaagcagttgatctgaggccggaagttgtaaaccttgtccgtggagacgaaacgaagagcatcccggcccaggaggcaaaggtgggggatatgatcctgatccgtccgggcgaccgaattccactagatggcgtcatcgttgaaggaagaagtcagatcgatacctcgccggtcaccggggagccagttccggtaaacgtatacccgggaaccgaagtctactccggatgtgtaaatgaccagggggttctgaagatggaggtaagaaagccgctcagcgagtctatggtaacccggatattggattccgtagaaaatgcggctgccagcaagccgaagatcgaccgcttcattaccaagtttgccaggatctatactccggtggtcgtagcagtcgcagctgctacggcagtgattccttccctggttaccggcgaatggaatcactggatctatacggcgattacgtttctggtaatcagctgtccatgcgctctggtactcagcgttcctctggctttcttctctggaatcggcgcaggctctaagaggggaatcctatttaaaggaggagtagccattgaagcgcttaaggatgtaaaggccatcgttatggataagacaggaaccataacgaagggaaactttgtcgtacagcaggtggtttctttgaaacgattgacgcagaagcagatcctcacaatcgctgcggactgcgagcttagttcgacgcaccctatcggcaccagcatcgtgtcggcggcaagggaaaagaatctggaactatccagtccgaaagaagcggaggaaatctcaggcaaagggattcgtgccgtgttcccggaaggaaccgtgctgtgcggaagcaagggacttctggaaaaatacggagtggatgtcagcggatatcagtcggatctgtatggcacagaagtgctgatagcggtagatggcgaactggaaggctatctggtggtcgcagatgtaatcaagccggaagcaggagcgtccgtgaagcgtatgaagtcacagaacctgatcacggctatgctgacgggagatgccagggacaatgcgatggcggttgcaaaagagaccggaattgacgaagtccatgcccagcttctgccggaagataaattaagccatttaaagcagatccgtaagaagcatggctccgtcatgttcgtaggcgatggcatcaatgatgcgccggttcttgccggggcagatgtaggcgctgccatggggaacggggcggatgccgcgatcgaggcggcggatgtggtattcatgacatcctcggtggacgccataccggaagcagtttccattgcaaggaagaccgggaaaatcgccatgcagaatgtagtattcgcgctggccatcaaattccttgtcatgattcttggattcacaggctatgccaatatgtggatggcggtatttgccgacacaggcgttgcaatgctttgcgtgctgaattcaatccggatactgtatgccggtcaaaatagtggcaatgcataagaaaatgcataagaaatagttacgaaaatattaattttaattcatttaatgccaaatggttgaaataacaatcaccatttggcataattaataaatgagtgaatattcatacctattggggcatgccgcgatagggtttatcatgctgaaaggaaggaatgtatgaagaagacagaagtagagtgctgcgatattacatgcattcatgatgataaagtccgtgcggtccggcagaggatgccggaggaagaacggttaaaagaactggcggatttttacaaagtgtttgcggatgctaccagaatcaagattttgtggattctgctggaatcagagatgtgcgtctgcgacctggcagagattctggggatgacccagtcggccatctcgcatcagcttagagtcttaaagcagatgaaactggtaaagaacagaagagaagggaagacggtatactattcattggccgatggccatatccagacgataatcagtcagggaatggagcatatcgcggaatagttttcatatagttatcaaaaaggacaatattatgaccgaggaattgaagaaaaggtgtatcatttatgcggtgggggtgtttgtgtacgtatgcgggatagcggtgaccatccagtatacgatgtccgaccgggcaaagttcatatggtttctggcagcatacctgattataggctttgatgcctttaaggtgctggaagagaagctggcgcagaagaagttcctgacagagtatacgctgattatacttgctacgataggggcttttggcgtggcgagatatgtagagggcgtacttgttatgctcttatttgaattggggatgatgtttgaagcctattccacggacagcgccaagcgttccatcaaagaactgatcgatatccggccggaatacgcgacccgcaaggtacacggaaaagaattcaaggtggatccttccgcgctgaaactaggacatattattgtaatcaagccgggagagcgcatccctgtggatgcggttgtcgtctccggcactacaagcattgatacaaaggctttgacaggagaagccatgccccagtccgcatggccgggagaccggatatatagcggatgcatcaacctcaatggggtgatcgaggcaaaggtcacggcgctgtatgttgactccaccgtaaccaagattatggagatggtagaagaggctcaggagaaaagggcggaaagcgaagattttattacgaggttctcaagaatctatacgccggttatgctggtgtgcgccttgctcgtcatgatctatccgccccttacattttcctatgggaattgggatacctggatctacagaggattgatcttcctcgtagtagcgtgcccctgcggactggtcatgtccattccgattgctttccttggcggcattgcgtcagcagccagacaggggatcgtgatcaagggcggcaactatctggaggacctttccaaggcagataccttcgtgtttgacaagactggaacgctgacggaaggcatattcaaggtaaaggaagtaaaagcggtggggatggacaatgacgagctgcttcgtatcgcagcccatgtggagagttattccaaccacccgatcgcccagtccctgtcagaagcctacgggaaagagatccataagaacaaggtataccggatgcgggaactgccgggctatggcgtcaatgcgacttttgaaggcgagcgggtctatgtgggtaataagcggctgatggatcggcagaaggttctctgcgatgaagtgagccgtgatggaacggtcgtctatgttgccatcggcaagaaatatgccggctatatcgtgatcgccgattctgtcaaggaagatgcaaagacgacactccaatacttgaaggaaaagtgcaaggcagtactggtaatgcttaccggagataccaagagcagcagcctggaagtagccaggaagctgaagatagactatgcgtacgcagaactgatgccagaggataaattagagcagctggaggactttttagatcttcaggattctacggagcgtctggtatgcgttggagacggaatcaatgacgcgccggtccttgcaagagctgacgtaggaatcgctatgggcgcgctgggctcggcggcagcaattgaggcggctgatattatattgatggaagatgaattgccaagaatcgtggacgcgatcaagattgcgaaggagaccttaagagtagtcagccagaatatttcttttgcattgattgtgaaggtgctgatcctgatacttgccacaattggctattttggaatgtgggaagcaattctggctgaagtcggcgtaatgttcgcggcaatcctgaatgccgtctgggttgtccgttatactgtttaggaggatatatgaagtataggaagatagccctgtctgtgatggctgctgccattgtattgacaggctgtgtaaaaaatccatctgaaaaaggagtagaatacctggaagatggaaaatataaagaagcgatcgaacagttccaggatgcaatcgattcggaggtgaatataggggatgcctacagaggaatcgggattgcaaaatgggagcaggaagattatgagggagcaaaagaagcgtttcagaacgcgcttgataatggtgccaagaagactggcaccatctataattttatgggaaactgcgatatgaagctctccaggccggaatctgcccttaactattaccgccttggcgtcggccaggaggatagcagcgaggaactcaaaaaagagatgcactttaacatgatcgtagcatatgaacagatgaaggattgggaaagtgcgaaggccaaactaaaggaatacctggcagagtatccggacgatgaagcagcaaaaaaagaattggaatttctggagacaagataatatatgggaaatatgattgatttggaaaaagagaccgaacgggttatcctggtaggcgtcagcgtgacggatgaggatgacacccagaagtcgttagaggaattaaaggatctggcttccacagccggagcggatactgtgggcgtggtgattcaaaaccgggagcaggtccatccgggcacttatgtaggcaagggaaagattgaagagatcaaagatctgctgtgggaattggaagcaaccgggattatctgtgatgatgaactatccccggcgcagatgaagaaccttcaggatgagctagacgcgaaggtgatggaccggacgctggtcatactcgatatatttgcgtcacgggcttctaccagcgaaggcaagattcaggtagaactggcccagttaaaataccgtcagtccaggcttaccggatttggcacggcgctttccaggctgggaggcggcataggtaccagagggccgggagagaagaaactggagatggaccgaaggctgatcaagggacggattgcccagctgaaccgggaattgaaagacgtgaagcgtcaccgggaggtcacaagagagcagagaagccgcaaccggattccggtggcggccatcgtagggtataccaatgcaggaaagtctacgcttcttaatacgctgaccggggcaggaatcctggcagaagataagctgtttgcaacccttgaccccaccaccagggaattgaagcttcccagcggacaggagatactgcttacggatacggtaggattcatccgcaaactgccgcatcatctgatagaggcttttcgaagcacgctggaagaagccaagtatgcggatatcattcttcatgtagtagatgcggccaatccccagatggacgagcagatgtatatcgtatatgagacgcttcagaatcttggagtaaccgataagccgatcattactatattcaacaagcaggacaaggcacaggacgatgccatcgtccgggactttcatgcagattatacggtcaagatctccgcaaagacaagggaaggaataccggaacttctcaagactatagaggcagtactcaggcagcagaaggttgccattgagaatctctatccttaccaggatgcggcgaagatccagatgatccgaagattcggggaactgcaggaagaagaataccgggaggacggcatctttgtcagggcttatgtacctgtggaaatctatgacaaagtcaaggtttcccggggggattcgccaaaaagccccttataagagcgggagaacgtggagtaatccttgaatccgcagtcaaaacaggcctgcgtgctgggcacgccggataatatcaagtcttttgcaagcaggagccgcttctgggagatatagcgtcccatagtatagccggtctcctgcttgaatagtctcatcatataatatttgctgatgtagaaagtgtccgccagatggtctatggtcagatccctgccaagattctcgttgatatagcgcaggatatccagaaccttcacattgcaattggcggtatcgataaattccagccggttctttctcgcggcgcggttcagatgtatcatgaattccaggaataggacctggcggtataatccggctgcatatccgtcgtcggaaaaggatttttccagctgagtgatggagcggaacagagagctcctctcaagagatgggatgcgaagaacgttggaatgctcttcttcggctttctgaaagcagtagctaagatcataggaatccgtctgataggcattgatgaaattgggcgatatatatacgatgatccgttcatatacggtagaattatctacaatcaggcggtggatatcattgtgctttaccagcacgatatcataagggatgagctcatatgattttccctccaccatgtaattgacatttcctttgataaatatggtgatcttgtcaaagtcgtgataatggtattccacctcccgagtctcctgatccgtaaggtggaacagtcggaattcgctatttaagtatcctttttttacatattgttccataagggctcctccttcttagagtttatcttatagcaagagagcattatttgcaatatgctaagcacgatttgtgttgaaatgggaaataatgcctgatatgatagagatataataacggggagcaataaggacaatcccaatggaaagacggaggtatgttatgaaggttgtgttggaacgttatcatgggctgggaaatgattatgttgtatttgaccctaataagaatgaactggaacttacaccgaagaatgtaaagatgatctgcgaccgtaatgaagggcttggctcggacggcgtgctggaaggacctatcctgaaagaagatggaatgcatgtaaaggtctggaatccggatggaagcgagtcggagaccagcggaaacggggtcaggatattcgcaaagtacctgaaagacgcaagctacgtacagaagaaaaactttaaactctatacaggcaatgggccagtggaagttacattcctcaatgaagacggcagccgccttcgcgtatccatgggaaaactgtctttttggagcgatgatatcccggtgacaggagagcgcagggaggtcatcaatgaagatatggtatttggaagaaccttgtatccggttacttgcgtatccatcggcaatccgcactgcgttattccgatgcgggagatctcgaagccgctggtatgcaagattggcgattacgcagaactggcaagatacttccccaaacggatcaatacgcagattatgaaggtgatcgataaagagcatgtggcgatcgagatctatgaacgaggtgcaggctatacgctggcttccggaaccggcgcatgcgctgccgccggagtcgcctataaactgggaatgaccaacaacaaggtcatagtacagatgccgggaggcgagcttcaggtcgagattgaagaagactggaacgtatttatgacaggcgacgtgttctatgtggcaaagattaccctgagcaatgagtttgttgaaaaattaagagcgatataatatactaaggcatagggaggaaaacctatgcctttacaatttatattcgggccgtcgggctcgggaaaatcatatcacctataccatcagataattgacgaatctaggctccatcaggagcagaattatatcgtccttgtgccggagcagtttacgatgcagacgcagaaggatctggtcaatatgcacccctgccatggaatcatgaatattgatgtgttaagttttgtcaggctgtcttaccgcgtgttcgaagagacaggcggagggacgctgcccgttctggacgatgaaggcaagaacctgattctgagaaagatagccggagactacgaaggggaactcaaggttctggggggaaatatgaagaagcttgggtacatcagcgaggtgaagtcagtcatctccgagtttgcccaatatgacattacggaagaagaactcgaacacgtcatggagacggcgggagaggaatccaggctatactacaagctgaaagacatccaggtgctttacagaggattcatggagtatctggaaaagaaatatattacaaaagaggaactgctggatgttctaagccagatggtctgcaagtctgatatgctcaagaacagcacggtagtgctggatgggtttaccggctttacgccggtgcagaacaggctgcttctggaacttatgacccattgccgcaaagtagtgattacggtgaccatggatgaccgggaagatccttacgtctatcagcacccataccagctcttcgggcttggaaagcatatggtgaccacgctgatgcggcttgccagagatcataacatagcggttgacgagccggtctgcctgtatggcaggcctccttatcgttttaaggatcatgattccctggcttttctggaaagaaacctgttccgctatcatgggaagggattcggaaaagagccggagtcgatcggaattcatgtgacaagaaatccgaaggaggaggccatggccgtggcaggagcaattcgggcgctggtgaggaaggaaggataccgctaccgggagatcggcgtcatcgtaagcaatatggacgtgtacggcgacgatctggagcaggcctttgccatgtatgagattccggcttttatggatcataagagaagcattcttctaaattcttttgtcgagtatatcaggagcctgcttgacatggcagaacagaattttacttatgaaagcgtgttccggtttcttcggaccaacctggcagggtttagctttgatgaagtggacaggttagagaactatgtcattggcctggggatcaaaggctataaaaggtggcaggagaaatgggtacgccgcttgaaggggatggaagaagaggaattggaggcgttgaaccactgccgcgtaatcctggtagagaaggtagacggcctgctctatgtactgaagcagagaagcaagacggttcgtgacattaccatggctctgtatgaattcatggtgcgcgaggacctgcaggtgaaactggcggctttggaagaacggttccaggcagaaggggaactggcgcttgcaaaagaatacgcccaagtatacaggatagtaatagaactgttcgacaaattcgtagaacttctgggggatgagaaggtcagcctgaatgaatactgcaagctgctggatgccggcctggaagaagcgagggtaggcgtaatcccacccagcgttgaccaggtggtggcgggagacgtgcagcggaccaggcttaaggatatcaaggcgctgttcttcgtgggagccaatgacacatatcttccggggccattgcttcgaaccgggcttctgtccgaaagggatcgggaaaaatttgccagggagaggctttctttgtcgccgggaggcaaggaacaggcctatatccagaagttttatctctatatgaatcttacaaagccgtccgaacagctgaatatctattacagcaaggtgtctgcggacggcaagagcatccgtccgtcttatctgatacaggaattgagacggctatttccattgcttccggtgcaggatgaggaaggcctggcgcttccgctgcgggagattacggagaagatgggaattagctatctgattcgcggttttcagggaaatggggaaggcatggacgcggcgtggaaagaactctatacctggtacaagaagagccctaagtggcagagcaaggtggagagcctgttaaaagccgggtattaccgccggcctatggatggattgaccgaggtcgttgccaaaaggctttatggggaagaatttgaagacagcattaccagaatggaaaggttccagacttgcgcgtttgcccatttcctgacctatgggctgaatcttcaggaaagacaggagtatgatttccaggcggtggatatgggaaatgtgtgccataacgcgctggagcgcttttcccggaaggtggaaagggaaggctgcggctgggttggattaaaagaggagaagcgggcttccttcattgacgaaagcgtggaagaggcgatcacggactatggcaattcggtattgtatagttctgcaaggaatgaatatatgatcgtgcgcatgaagcgcatgctggagcgtacggtgtgggcgcttaccaagcagctgtctgccggagacttccagccttctgcctatgaattccggtttgcgaacggcaagatcgaccggatcgatacctgcgaggatggggataaggtctatgtaaaggtgctggattacaagaccgggagcaaggcgttcgatgtggtcgccctgtatcatggtctccagttacagctgatggtgtatatggacgcggcggtaaaagcggagcagaaaaagcataaggagcaggaagtcgttccggctggcgtgttctattatcggatccaggatccgcttgttgacaagcaggaagaggcctcggtggaagaggccctattgaaggaattgaagccggatggaatgatcaacctcaaagatgaggtgctccatcatctggaacaccggacggagggggaatccctggcagttccggtgaagttcaacaaaaacggaagcctggcaaagagttccaaggccgtgccggaggaagaattccagatcatgatgcggcatgcggcaagaaaagtagaagaaacccaccagagcatcttaagaggagagacgaaggcctcgccatacagaagaggtcaggagaccggctgtgattactgcaagtaccggcacgtatgcggatttgatgtgaaggttccgggatacgcttaccgggatatcgggaagatgagcaaagaagaagcgatcgctgccatgcaagccgcttcgaaaggagaagaataggtcatgaaagttacgtggacaaaggaacagcagaaagtcatagacctgagaaacaggaatattctcgtatcagctgcggcaggctctggcaagacggccgtcctggtggaacgcattattactatgctcacggaggatgaaagcccggtagatgtagatcgtctgctgatcgtaacatttacggaggcagcggcggcggagatgaaggaacgtattcgcaatgccattgagaagaaactggaagaatacccgggcaacgagcatcttaagcagcaggccactttgatacacaatgcgcagattacgacgattcatagtttctgcctgtcggtgatccgggatcattttcacgcgattgacatggatcctggatttcggattggagaggaaggcgagttgaaacttctgcgccatgacgtgctggaagagatgctggaggatcggtaccagcggggagagcagagattcctggacttcgctgctgcttatggcggcgggagaagcgataagaagatggaagaactggtgctgaaaatctatgagtattccaggagttacccggacagtgaaggatggctgtcctcctgcttggaggcctataacgcggacagcctttcggaattggaggaaagtggctatattcttctggtgatggataatgtgagacggtacctttatgatgccggaaggcttcttcaggaggggctggatatctgcagtgacccggatgggcctgcggcctatgatacagctcttcgaagcgacatccagatgatcgaggaattgagggggacgggcgcgtttacggaacttggagtaaagatgaatagcgtaaagtggatgaggcttgcagccaaccgggataagacggtgtcggaggaaaaggcagccaaggtaaaggcgatccgggaggaggtaaaagggctggtcaaagatctggccggccagtatttttatcaggatgcgccgggaattcttgaagaccttcagatctgccgtcctgcgatggaggaactggcaagccttgtccgggagttcgctgaaagattcgaagaaaagaagcgctccaaaaatatgattgacttctctgatatggaacagtatgcgctgaggattcttactgataagacggacgaaggatttgccccttcggtcatcgccagggagtaccagcagcagttcctggaaatcatgattgatgaatatcaggacagcaatctgatccaggaagcgatcctaaccagcatctctaccgtgtctgagggacgttataacatattcatggtcggggatgtaaagcagagcatctaccgattccgcttatccaggccggaactttttatggagaaattcgatacttatgatacggatgacagcaagacgcagagaatcgaccttcataagaacttccgcagccggcgggaagtgctggaaggagtcaactatattttccgccagatcatgacccgggaactggggggcatcgtctatgacgaccaggcagcgctgtatgtgggcgcggattataaagatggagaaaatatggagacagaggtgctggtcattgacagcaacgtggatgcatgggaagatgaggcgcagtcagttcagggaattacggaacgagaattggaggccagggcgatcgccgggcgtatccgggaattaatccatcaccagcaggtgacggacaagaagaccggggaattccggctggcgcgctattcggatattgtcatactgacccgaagcataaaaggatttgcggatgtgtttacggaggtgttgagcaaagaagggattccgacctatgcaggcaccagagagggatattttgcaacccaggaaattggggtgattctggattacctgcgtgtcctggataaccagaggcaggacatcccgctggcagcggtgctggcctcgccgattggcgctatgacggaggaagaactggcgattataagaagcagttataaagaacggcccttcttccaggcggtatcagactatcttgcgggaggcgaagatgagtctattcgtggcaagctgggccggtgcctgggccagatggaggcatttcgcaaggtggttccttatacgcctatgcatgagttgctgcatatggtgctggagaagaccggctacggcgactatgcctgcgccatgccgggaggcgagcagaggaaggccaatcttgacatgctggcagagaaggcaagggtttttgaatctaccagttataaggggctgttccattttatacgctatatagaacaattgcagaagtatgacgtggattatggggaagcgagtattgaagatgagcagtctgacacggtgcgtattatgaccattcacaagagcaaaggactggaatttcccattgtgttcgtagccggaatggggaaacggttcaatatgcaggatgccagaagcagcgtggttcttcattcaaaaatgggcgtgggcctggacgcgattcatattgccaacaggacgaaaagtccaagccttgtaaaaaagattatccagaaggaagaagcattggacagcctgggcgaagaattaagggtcctctatgtggcattaactagggctaaggagaaattgatcattacgggaactattccaaatctggagaagaagatgccgctctatgagatggggattacatttggccgtcttagcaaggcatctacttattgggactggattcttccggcagtatccagcgtgccacccgaggttcctatcgcagtaaaaaggatagcatttgacgatattgtaaaagaagaagtcatagaagagactgccggaaggatgaccagggcgatgctggaagcatggaataccagccaggtctatgatccggccatgcatgaggcgataaaagagcagtttggatatcagtatccatatgccggaagcggaatgcagaaattaaaatttaccgtttccgaacttaagaagagaatctatctgaaggaaagcctgggcgaggaattagacgaaagaggcgaattattgtatgaagagcctgaagtggttccgctcattccaagattccttaaggaagaggaagaactgacaggggcttccagaggtacggcataccaccgcctgatggaacttctggatcttgcacaggattatggggaagcggaactggcggacgcggtgagcgcatatgtggaagaaggaaagatggacgcggatatggctgcctgcatacggcacggcgatatcctgggctttttaaatggcggggcaggacagcgaatgaaagcggctgcccgggcaggcgctctatggagagagcagcccttcgtgctagggatggacgccagagaaatgtaccccgaagaacaggaaggcgagctgatcctggtacagggaatcatagatgcttactttgaagaggcggacgggctggtagtcctggactataagacagaccagatatacacgccggaagggctgatagaacggtaccattcccagctggactactatgcgaaggcgctggagcagctgacacagaaaaaggttaaggagaagattatctactcctttactataaagaaagagattcgattgccatgacacagatattagctgtatatataatactcataaatattgttacattctgggtgttcggacatgacaagcgccaggccaggaacaaaggctggcgcgtgccggagaagaccctcttccttttggcggcagctggagggagcattggcgctatagcaggaatgcagatattccgccataagaccagacactggaagttccgcttgggaatgccgctgatattgggagcgcagtgtgtggcggggtggtggattttttgggcgtaggcttgtgattgttaaggaggacggcgtagggaggggctgtggcttgcagcggctccgactcgcttcgccgggaaagtataagcagaaaaacctgatttacagataaccggacatattcggcgtgaaattctgaaagaatttcgcacctcagatgtcctcgaagattttgtttgagacaaaatcttcgtatctggaaatcaggttttttttgctaacactttcctacggctccctcgacggaccaccgcaagccacagcccctccctacgcctgctttctaagaagccacgatgctgcgccgtgggggagaaatcgccaggaagccgcaagaagtacatattcgtatcattttgctcaatgctgcgttgaggctaaagtctaaagatttctattgctaaacttccgcgactaaaataaatccggtgaaaagtgtaatttaacgcaggcacaccacgcagaattgccaacaaattgccggtagccggggagggcggggaggctgtttcgcagggaagcggaggcgtccggaatatccatgcccggaatgttaggccgcgggagaggagtcagccgacgactctcccgcagacttacatcccggtgcatgagatgcaggcgccgaagcgtcgaagaaacagcctccccgccctccccggcgtaccacaatccccaattcctcaatttccataaaaatattctcgcaaaaaatataatatgtgttgacaaatcatattatatgacatataatataaccatcaaaacaatattgtaatgaaagatatattataaaattccagcaaaggagtgagaatatggtatttaacaccggagccgctcttctggacgccatagtactggcggtcgtatccagggagaaggaagggacttacggatataagattacccaagacgtaagaaaggccattgacgtatcagaatcaacattatatcctgtgctaaggaggctgcagaaagacgaatgtctggaagtatatgataagcagtttgacggacgcaaccggcgctactacaaggtgacggaaaaaggtatggcgcagttgaatctatatcgggtagaatggaaaaattattctttgaagattaatgaattgtttgagggaggtgtgactgcatgaaccgcatagagtttatgacagaattagccgcattattacaggatgtgccagtagaagaacgcagagaggcgatgcagtattataacgattattttgatgatgcgggagaagagaatgaagagcaggtgatatctgaattaggaagccctgcaaaggtggcggccacgatcaaggccgatctgggaagccaggccggcgattacgcggagtattcggagaatggatataccgactccaggtttgaccagaaggagatgccggcgggcagggactatcagaggaaggaagaaaaagagcctccgaagaccagcagggcgttgaagatcgtactgattatcgcgatcattctggttggtgcgccagttctgattccgctgggagttggaataacgctggcggtacttggatgcataattgcgttgttctgcgcgtttatagcgctggtaattgcatccgtggcagtagcgattgcaggaatcgtggtattctgtgttggaatcgctacattgattccggaacttgccgtaggattagcgctggtaggaacaggactgatattaacggtactgggcgtgatagcaaccgtagcaagcgtgaagctttgcctggtagtattcccggggatctgtagaggaatcgtatggatctgccgcaggccgtttcaaggaaaggcggtggcataagtatgaaaaagggatggaagatattctggatagtatgcgcggcaacggcagcgattggctttgtgtgctgtgtgatcgccaaggtgctgggtgttacgacagatatgatagaaggacgctttccgcatggcataggggtgttttcccacaattatacggtggatgattatatcaatgacgatgatgacatcccccttgcggatgatatgaaaaatagttatagcaacataaccgaaatagatgtagacatcttcgcgggacaggtgaaggtcgtgctttccgacgatgcaaaagatgtaacagtcgagacaagaggcatcaacaagcgtctgggacttaagtgctatcaggacggcgacgaattaaagataaagtctaaggaaaggatatggcatgtcaacaatgtggggtcaggaacgattacgattaccctgcccagggacttaaagctgaatgaggcatcctttgacattggagccggtacgctggatatagaaaagatttttgcccaggatctgtatgtgggcgtgggagcaggcgatgcgaatcttacgcattttgaagcaggcgaggtagaatttgactgtggagccggaagcatccatgcgaatggagatgcaaggtcagagatcgatattgacggcggagtgggcgagattatcctgacggtttccggagaagaatcctcttacaattatgatatcgactgcggagtaggagaagtcatctgtggaaatactacttattcaggcttagccaatgaaaagaatattgacaatggggcttcaagagatattacggtagattgtggagtggggaccattacgattaattttggaaatgcattataacggggacgtccaagaaaaccggacgcgtgaatgaaaggagaattattaaatggaacagaaaagactgtatagatcacgggaaaaccgcatgatatgcggggtatgcggaggcatagccgattatttcaacgtagacccgacgctgattcgtctgggacttgtgttattagcttgtactggttcaggaatcctggcttattttatagcggctattataattccggaccaaccaagaacatattaatcttcaaagagggagaagcatccgtacagggtgctttttccgcgtataaggaaggcgggaggggctgccagtatattccatccaaaaggtgtcaatacttactaaaaaatgaaaggggtattgtgctatggctggaaagaagaataaaccgatcaagctggatgaactgacacaggaagaaaagatgaaatacgagatcgcggaggaactgggactgctggacaaggtaatgcaggagggatggagatcgctgtcatccaaggagacaggcagaatcggaggcctgatgacgaagaaaaggcgggaagccgagaaaaagtaacaaaaatattacgaatattaattagtgtgaacaattggtcataaaggttgaaaagagggtatccatttgctataatcgaaaaactggtaaaaacattagcaggtgaagttatgagcgataagattaaagttttagatattgatatagataactgcacggccaaggaagccatgaaggaaaccatggagtatctgaagtccgagccggtaagcgtgatagagatggttacggtggatggattgatgcagatggacgaattgccggaacttaaagagaatatgcaggaattcgatcttgtactggctggggataagacaatcctggaggcagcagatatcacagaccgcaagttccttcaggagacagaaggccatttgttcctgaagatgtttatgcgataccttcataagaaccataagagaatctatcttctggtggagacggaagaggagggccaggagttctatgactaccttcagagatactatagcggactccagattatcggactggcaaaggtatcggcaaggaaccgggcggatgatatgctggtcaatgcgatcaacggcggcgaggtggactgtatcttcgcggcgctgtcggcgcctcttcaggaggactttattatgaagaaccggagtcttctggatgcccgcgtctttatcgggctggggaaggaaagccttccggtaaagaaggcaggcctcgggcagagcaggattggacagttccttatccggtgcattttcaagaaagagattgagaagcgcaagcgcagcgagccgaatcaattctcccccgcaaaataaataagaaaattataagatttgacttttcgtcactatgtacatggccaaaaactgaatattttattaaaatcttgaggaaattaacaaaaatatgtgatttcctctttatttttttgttgatatatattaagatagaattcagtagtatgcattttggctactttttcaagtaatttgttgtgaaaaatgcatattgaaatgagtggaggagatggaatatgatatctaatcaaatacttcaaaatacgattgaaggattgaaagggattacacgaattgacttctgcgtaatggacaccgacggtaaatctcttgcaagtacattttcagaacaggacaactatgaagaagaggcagtctccttcgtagaatccccggcagacagtcaggttgtacagggatatcagttctttaagatttttgacgagcatcagctggaatacatcctgcttgccaatggaggcagcgatgatgtatatatggtaggaaagattgccgcgttccagattcagaatcttttagtggcttataaagaacgatttgacaaggacaatttcattaagaacttgctgcttgacaacctgctcttagtggacatttacaaccgtgccaaaaaattacatattgacacagaagtgagacgtgttatctttattattgagacaaagcacgaaaaggacagcaatgctctcgacaatgtgcgcaatctgctgggcaaccggacgaaggatttcgtaacggcagttgatgagaagaatatcattgtcgtaaaggaactggagcctggcgacgggcacgaggaactggagaagatcgcgcagaatttgtatgtgctcctgaaggaagatggagaagaagagatcctgatcgcttatggaaccatagtcaatgacattaaggaagtgtctaagtcttataaggaagcgaagcttgccctggacgtgggcaagatattcttcggggagcgaagcgtaatcgcttacagtgctttgggaatcggacgcctgatataccagttgccgattccgctatgcaagatgttcatacgtgagatttttgaggggaaatcgccagatgatttcgatgaagagacgttgactaccattaacaaattcttcgagaataatctgaacgtatcagagacatccagacaattatatattcaccgtaacacattagtataccggctggataagcttcagaagagcacggggctagatctgcgcgtgtttgaagatgccattacattcaagatcgcacttatggtcgtgaagtatatgaagtacatggaatcactggagtattaataatcaggaggaaagtatgattgaattaaaagaagtaacgaaagagtactcgaaaggggttgcagccctgaacggcgttaacctgaaggttgagcagggcgaatttgtatttatcgtaggggacagcggatcaggaaagtctacgctgattcgtttgatcatgaaggaactggaccctacctcaggaacgattatcgtaaacggacagaacctgaaccggatgaagcacaggaagattccgatgtacagaagaggaatcggagtcgtattccaggatttccggcttttgaaggacaggaatatctatgataatatagcatttgcacagcgcgttacagagacgcctacccgaatcatcaagaaaaaggtgccggcggcattatcgctggtagggctggcccagaagtacaaatcatatccaaaggaactctccggaggagagcagcagcgtgttgccatcgcaagagcgatcgtgaatgaaccggcaatcctgctggcagatgagcctactggcaacctggacccgacaaattcatgggagattatgaaactgttggaagaggcgaacgacaggggaacaaccgtattggttgttacgcataaccaggagattgtaaacgagatgaaaaagcgagttgttacaatgaagaagggagtcattgtaagcgacgagaaaaaaggtgggtataataatgagaattagtacagtaggatattcgatgaaacaaggggtgaagaacattggaagaaacaagatgttctctatcgcatccattgcgacgatggcagcgtgtatcttcctgttcggcttgttctactccattgtcatcaactttaactatatcgtggaaaaagcagaagaaggggtggcgatcaccgtattctttgaagaggatgctacccagagccagaaggataagattggcgatgagcttaagacggccgatggcgttcttgaagtaaactatatcagcgcggatgaagcgtgggataagttcaagggcgattatttcggagagtcaggagatcttgcggaaggattcaagagcgacaatccgctggctaattctgacaactatgaagtctatatggaagacgtatccaagcagaaggatgtcgttgcatttgcggaaggcctggaaggggtccgcaaggtcaacaagtcggatgtcgtggcaaagacgctgacaagcgtgaataaattagtgggctacgtttccgtggcaatcattgcaatcctgctggcagtatccatattcctgatcagcaatacggtcaccatgggtattacggtaaggcgcgaggagatagcgattatgaaatacataggcgcgaaggatggattcgtccgggcgccgttcgtgatagaaggtctgatcatcggagcggtgggggccgtgattccgctggtgatgctgtactttatgtatgacaaggcgatttcctacatcatgaccagattcagccttctgaataatattgtagacttccttccagtggcaaccgtctataagacactgcttccggtgggaatcgtactgggagtcggtatcggtttccttggaagtttctttaccatccgtaagcacttgaaagtataatttttaagggggatacatatgatacgagggaagaggttgataagccttctgctggcgcttatgctatgcttaggcctggctatccaggcgaatgcggctgatcttagcgacacgaagaaaaaggcgcaggaactggaagaaaaaaagaaagcggcagagggcgagaaggcgtctctggaggcacagttaagttcgattgtctcggagatggaggataccaagacaaagatcgacgagaaagagtctgagataacagagaaggaagacgaactgatccaggccaaagtcgatgagaacgaccagtatgaaagcatgaagaagagaatcaaatatatgtatgagaacggcaattctcagtttatcgagatattgtgcgagtctaagagcataggggattttcttaacaatgcggagtatattacgaccatttcggaatatgaccggaatatgctggtagaattccaggaggtcgtaaagaaggtggaagaccaggaggctgcgctcaaagaagagtacgcagaactggaaacgatgcagaatgacctgatcgcgaagcaggatgaagtatccggccttatggccagcaaagaggacgagatcagcaagctggacagcgagctgggagacaccaaggataaattgtcccagctggaggcggcagcggcggcagcgcagcgcaagcagaaagaagcgtccggaggcggaggcggttcagccggcgcggctgtagtgactggcaatggaacctttacccatccatgtccgggatattcttatatatccagtccgtttggttacagggaacagccactggcaggcgcaagcacaaaccataaaggcatcgattacgcggcaggaaccggaaccccgatctatgcggcggcagcagggacggttgtctcagcaggatacagcgggaatgcaggaaagatgatcgttatcaaccatgggaacggattgacgacgtattacatgcattgcaatgacctgtatgtaagcgcggggcagtcagtcagcaaaggacagaacattgcggctgtaggaacaaccggcaattctactggaccgcatcttcatttccaggtaaacttaaatggcacaccggttaatccggcaaattatctataagaacaggatttaattagatgaaaaacaaaaaaggatttttgcagggggcgctttgtggcgcccttgctatgttattggtggcagggcttgtatcctgcggattaaaaatgaaggatagcggcagcgggaaagacgctgtcgatagcagcacgcagaagaaagtatcggaactaaaggagttgatcgatcagaattacatgggcgatgtagaggaaaagcaattggaagaaggcatctacaaaggcttcatcagtggactggatgatccctattccgtatactatgacgaggaagagaccaaatccctttatgagaccaccgagggagagtatcagggaatcggcgcagtgctgagccagaatatgaacaccggcatcatcaccttggtgcagatctatgatgattctcctgcgatgaaggcagggcttaaggataacgatattctctacaaggtaaatggggaggaagttaccggcgtagaactgacggaggtcgtctcccatataaagggggaaaagggtacgacggtagagatgacggtgctgcgaggcgctgacaatgaagaagtgacggtaaccgctacccgggatacggtcgaggcccagacggtcaagtatcggatgatggatggccagatcgggtatgtatcggtctctgaatttgacagcgtcacctatgaccagtatcagaaggctcttaaagacttagaaggccaggggatgaaggggctggtagtggatctgcgcaacaatcccggaggcaatctgaataccgtctgcgacatgctggatttgatgctgcccaaagggctgatcgtatacacggaagataaggacggcaatcggcaggaggcctcatccgatgatgagaaccagttcacgctgccgctggcagtattggtaaatggcaatagcgccagcgcttccgaaatctatgcaggcgccattcaggattacggaatcggagatattgttggaacccagacgtacggaaagggcgtggtacagcagatctttgacctgaaggatgatacttgcgtgaagctgaccattgcaaaatactttacgcctaaggggagaagtattaacggtaaaggaatcacccccgacgtagaggttgagtatgaggcggatgagaataatccggaagccgacaatcagctggataaggccgtggaaacgataaaaaacaaactgtaaagagccaaaaatccaaagggaatgccaaatggggcattcccttttattattccatgtgataaaataaactacagtatggaattctatgccccatgggcatgctgtcgtgccaaggcagggacagcggaaaggaaagcatatatgacgatattaattaaaaatggacatgtcgttgatccgcttacaaggatggacggagactacgatgtgctgattgaagataaccgaatcaagaaggttgcggcaacgatagaggaagaggcagggcaggtcatcgacgcggagggctgctatgttatgccagggttcatagacttgcatgtgcacttcagagatccgggactggagtataaagagacgctcaagaccgggggcgcggcggccgtaagaggcggcgtcacgacggtgtgcgccatgcccaacactaagcctgtcattgacgatggagccaaagtcagagatgtgcatgaaagggcaaaaaaggactctcttgcaaatgtgattcagatcggcgcagtgacaaaagagcagaaggggaaggaactggcggatattgaggggatggcgagggaaggatgccatgccatcagcgaagatgggaagtcggtaatggatgcctccctctacagaaagggaatgaaggcagccaaagcatgtggaatctcggtttttgcccactgtgaggatatcaacatggtggaaggcggcgtgatgaacgcggatgagaatgcgagacgtctgggaatgaaaggaatcaccaactccgtggaggatgtgatcgtggcaagggatatcctgctggcgaaggagaccggcgtgcggcttcatctgtgccactgctctacagctgacagcgtggagatgatccgcctggccaaggaagaggggctgccggttaccggcgaagtgtgcccgcatcattttaccttgtgcacagatgatatcaaggaagatgatggaaattataagatgaatccgccgcttagaagcaaaaaggatgtggaagcattgagaaaagggctggcggacggcgttatggatgtcatagctactgatcatgccccccactcggaggaagagaagaaccagtccatggaaaaggcattctttggaatcgttgggctggagacgtctgcggcgctgacttatacggaattagtaaagccgggcattcttagcatcatggatatggcggaaaagatgagtttcaatccggcgaagatactggggcttgaggagaaaggctctgtatccgaggggaagattgcggatattgtgatctttgatccggacaagtcctacgccattgataagaatacctttgcgtccaaaggaaagaatacgccgtttgacggctatccagtgacagggaaagtaagatatacgctggtcgatggcagaatcgtgtacaaagatgagaaaaactaggaggtagaagagttgattaaccagttgattgcaaatataaaaaagacggaagcccccatcgttgtcgggctggatccaatgttaaattatatcccggaacaggtacagaagaaagccttcgcagaattcggcgagacgcttgagggagcagcggaagcgatctggcagtttaataaggagatcgttgataagacctatgacctgataccggcggtaaagccgcagatcgccatgtatgagcagttcgggatcccggggcttgcggcttttaaaaagacggtagattactgtaaggaaaagggcctggtcgtcatcggcgatatcaagagaggcgatatcggctccacatcagccgcttatgccacgggacatattggcagggtgcaggttggggacaaggcctatgcgccgtttgatgaggatttcgtgacggtaaatccgtatcttggatcggatggagtgaatccgttcctggatgtatgcaagaaagagaaaaaaggaatcttcgtgctggtcaagacgtccaatccttccagcggagagttccaggatcagctgatcgatggccgcccgctctatgaactcgtaggcgagaaagtggcagcatggggtgaagaagtcatgggagatgcttacagttatgtgggcgccgtagtaggggcaacctatcccgagatgggaaaggtgctcagaaagatcatgccgaaagcctatatcctcgtgccggggtacggcgcgcagggcggaaaaggaaaggacctggtacatttctttaatgaagatgggctgggagcaatcgtcaactcctccaggggaatcatagccgcctataagcaggagaaatatcaatccttcggtccggagaacttcggggatgcctccagggcagccgtggaggacatggtaaaggatatcaagggtgctttggagagccgcgcataagcaaagattggatgaaggggataggaggacaaagatgagcaagtataaagaacaggcgaccgtcgtctcgcaggagagaatcgcgacagatatctacagcctgtggattcagacggagaatattgccgcagaggcaggaccgggacaatttctgtccgtatataccagagatgagagcaagctgcttccccgtcccatcagtatctgcgagattgataaggctaagggctatatccggctggtataccgggtgaccggtaaaggaacagggacgcagcagtttgcggcactgaaggaaggcgaccaggtttcagtcatgggacctctgggaaatggattcttaacggattgcacgaagaaggcatttctgatcggcggaggaattggaataccgccgatgctggaactggcaaagcagctagactgcgagaaacagattgtagcaggataccgggacgaattattcctgacagaagaactaaaagaatacggcagcgtctatgtggctacggaagacggaagttctgggaccaagggaaatgtactggatgccatccgtgagaacgggctggatgcagagattatctatgcctgcggaccgacgccaatgctccgggcactgaaggcgtatgccgaggaaaagaatattccatgctatctatctttggaagaacggatggcctgcggcatcggcgcttgtcttgcatgcgtgtgccagtccaaggaagtggatggccacagccatgtgcataataagcgggtctgcaaggacgggccggtattcttgtctacggaggtggaattataatggatacgagaattaatcttgctggtgtagagtttaagaatccggtcatgacagcatccggaacctttggatccggggaagagtatagcgaattcgtagatcttaacaggctgggagccgttgtcaccaaaggcgtggccaatgtgccatggccgggaaatgccacgcccaggatcgcggagacaaaatgcggcatgatgaatgccatcggactgcagaatccgggaatcgacgtattctgccagcgggacatcccgttccttaagcagtttgacaccaggatcatcgtgaatgtctgcggacggacaacggaagattattgcgaagtggtggaacgccttgccgatgaagcagtggatatgctggagatcaacatttcctgcccgaatgtaaaagaaggaggcattgctttcggacagaatcccaaggcggtcgaggcaattaccgcggaggtgaagaaacgggccaggcagccggtgatcatgaagcttagccccaatgtaacagacattacagagactgcaaaagcagcagaggcaggcggagcagacgcactttccctgatcaacacgctgaccgggatgaagattgacattcataagcgggcatttgccctggccaacaagaccgggggactatcgggtccggcgatcaagccgattgccgtcagaatggtctatcaggtggccaatgcggtgaagcttccgatcatcggaatgggcggaattgctacggctgaagatgcaatagaattccttcttgcaggggccacggcggtttccgtgggaacagccaatttcttcaatcctgccgcgaccatagaagtggcggaaggaataaagcagtatatgaagcagtatggatttgcccgtgttgaggatatgattggcattgttaaatagttgaagaagcggccggtgaaaaggctgccgggggagaacttccacaggagggtctcccttatgctttgtaataagaaagatgcaatatacaaagcaatccctgaaaatgataaagatgtttttgcatgaaaggcaattgaaagattcattttcagatgctataataacttgatgcactagaatcacagaaggtgccataaaaaggagatgttgactatggaacagtataaacaggaatttattgaattcatgattgactgcgaagtattaaaattcggagactttgttaccaagagcggaaggaacacgccatttttcgtaaatacaggattttaccgcacaggagcgcagcttcgcaaattaggtgagtactatgccaaagcgatagaaagcaagttcggctttgactttgacgtgctgtttgggccggcctataaggggattccgttgacggtggcgacgacgatggcgatcagccagttctatgacaaggatatcaagtattgctccaaccggaaagaggtcaaggaccatggcgacaaaggaatccttcttggaagtcccattgccgatggagacaaggttgtaatcattgaagacgtgacgactgccggaacctctattcaggagacgctgccgatcatcaaggcacagggagacgtaaccgtcgcgggcctggtcgtttccgtagaccgtatggagcggggacagggagagaagagcgcgctggctgagattgaagaaaaatacggacttaagacaacggctatcgtaacgatggcggaagtggtagaacatctgtacaataagccatataaaggaaaaattattattgatgatacattaaaagcagcaattgacacatattataaacagtatggcgtgaaataagaccaggagggattatgatgaacgagagagcgtataaggctatgagttttgccggggcagtcaatattgcagttggaattgtgatagcagtcgtaggagttgcggcaggagtgctggcaatcatcagtggagcacgcttactgagagagaaaaaagggcttactttctaagaagtccggattgaaagggtgcttgatttttgaattcaaagagcagaaaaagaatccgtattctcggaaagatattgttcgtactgtatattatatttattatttactttctgatattttccgattggtacggacgcacgggagagatgcaggagtaccattataatcttgtgctctttaaagaaataaaaagattctgggagtatagagaccaggttggcatgtttgccatgtttaccaacctgtttggaaacgttattatctttatgccgtttggattctttatgccgatggccagcaaatacagaagcttattctcgacggtgttctacagtttcggtctaagcctctgcgtagagacgttccagctggtcacaaaggtaggaagttttgatgtggatgaccttctgctcaatacgattgggggactggcaggctacatcttattcataatttgcgcggcaataaggagaagacatgtttataaaaagaaaaataaccacagaagaagatagggcaaaagccatcgcaaaggccagggaaaagcagagaaagaaaatgatcaagaccaagtatggccaggcgcctcttcggcattcaaagaagggggtatattcctgcttttacgcagtggtcgtgtttatcctgctggttctcatgctgatcatcgcatttgcaagcaagggcgaggtgaatatcctgataggattcatcggcctaggcacgctggcgctatcctttatgggcctgctgctgggcgtgcggggcttccgggaaagagataagaattacataacgtgcaaggtggggattggcgccaatgcggccttcctccttggactgactgcaatattcatcagggggctgttttaaatgatagaagaaagatatgaattggcaatcgggcgtatccgtgaaatagaaaaagagagtacggttggcagcgaatttcgggattatttccacgagatggcaggatttgccatcatgatagacgaactgcggacagaacttcaaagcggcagattccaggcgctgggactggatgaacttaaggaatggaaccgccggctgtatcaggatattcttccggaacggtatgaagcgagttatgggaatccctcttatgccgtgaagcagtgcgggaaggactacggcttagtcttaagcttcctgtacgcggaacttagaggagccattgcctatacatttgagcagaagacggaatatctggatatcctatttgaacttctggtcgaagtatacaatcaatttgaaggagagccgtatccggcgattgataatataaaggagaccatctattggtatgccagcgattattgcgatgtattcgtcgcagaccggatccgggagcagattgacccggatgaaagcttcgccgcaggcatcattatggacagcgatcttgacgatataagatacctgtaccagttcggcgagtatataagcgagaatgaacttcagacggccaggcatctgatgaagctggatgacgcagttataaagaggatggccgatgtttacacggaaggataccggatcggatttgtgaataccggaaaggatctgtcaaagaaatctacggttaatatccgctatgtccttggatttgagcgggtcattaaaaaagccattgctaattttgagaagatggggcttaagccggtgatctaccgttccggggtcagcgtcctgaccaaaaggcagcatctaaagattgggtattttggggctgtcgcgaataagcagtacgagtatgaccataggaatgaccaggcgctgtttctggataaaaagttcctggaacggaagctggaagtcgtcaagactacgtatgagcgttataaggaattggctgccgggtttgccggtcctgcctgcattgagatgtttggagaagaaccttttgcgcccaagcagaaggaagaggtattgaaactgtccgaaaagcaggaggaacttgtactgctctacgacagccgccagagtcagattaccaatgagtatatccggggggatgagaggagttacacgattgtggcttatccggtcccagagattggcgagaagtatgaagagatcttcgatgagatcatccgaatcaatacgctggacgccgggatctatgagaaagtacagcagacgctgatcgatgcacttgatcagggaacgtatgtccatattcttggaggaaacggcaatcggacgaatctgaaggtccagctgcatccgttaaaggatccgcagaaagagacgatatttgaaaactgcgtagcagatgtaaatattccggtgggagaagtctttacttctccggtgctggaaggaaccagcggcgtgctccatgtaagcaaggtctatctaaatgaactgcagtataaggatctggagatcacatttgccaatgggatgatcgcggattataactgcggaaactttgaccgggaactggagaataaggaatacatccatgataatattctccacaagcatccgaccctgccgcttggagagttcgcgatcggtacaaatacgaccgcgtatgtggcggcacgaaagtacgggattgaagagaagatgccgattctgattgcggagaagatgggccctcactttgcggtgggcgatacctgctatagctggagcgaggatatcaaagtatataatcccaatggaaaagagatcatagcgcgggataattccgtatctatccagcgcgaggaagatgtgtccaaggcatatttctactgccatacggatattaccattccttatgaggaaataaagagcattacggtcgtgacgaattcaggggaggaaattatccttcttgaaaatggaagatttgtccttccgggaacggagattctcaatgaaccgttgaaaaatgcagataaataatgtatcatgaacccatagtgccggaagcctggatagcgcggctctggcgcagttatacgagaaaggatgaagattatgccaaaagtaggaattgtgatgggcagcgactctgatctgaaagtaatgagcaaagctgcagcgatgctggaaaaattaggaattgactatgagatgacgatcatctctgcacacagagagccggacgtgttctttgaatgggcaaaggcagcagaaggaaaaggaatcaaggttattatcgcaggagcaggaatggcagcgcatctgcctggaatgtgcgccgcattattcccgatgccggtagtcggcgtgccgatgtcaggcaagaatctgggaggagaagacgcgctgttttcaatcgtgcagatgccgcctggaattccggttgcgaccgttgcgattgacggaggcatgaatgcggcgattctggcagcaaagatcctggccacctctgacgaggaactcttaggcagattaaaagaatattccaaagagatgaaagagactgtccaggcgaaggctgcaagactggaagagatcggctatgaggaatacctgaaataaaagaatagaatgatgaaaacaatatacaaggagatatgttatggattataaaaatgcaggtgtagatattgaagctggctacaagtcagtggaacttatgaaagagcatataaagcagactatgaggccggaagtcctgacgaatatcggaggattctcaggggctttctccatggaggcattcaagaatatggagaagcctacgctggtatccggaacagacggcgtcggaacaaagttaaaactggcatttattatggacaagcatgatacgatcggtatcgactgcgtggctatgtgcgtaaatgatattgcatgtgcaggcggtgagccattattcttccttgactatattgcgtgtggaaagaacgagcctgagaagatcgcgaccatcgtaagcggcgttgccgacggatgcgtgcagtcggacgcggccctgattggcggggagacggctgagatgccaggattctatccggaagacgaatacgatcttgccggatttgcggttggcgtggtagatgagaaagacctgattacagggaaggaattaaagccaggagatgtgctgatcggcatggcgtcttccggcgtgcacagcaatggattctcccttgtccgcaaagtctttgagatgacggcagagtctctgaatacatattatgacgaattgggaactacccttggggaggcgctgcttgcaccgacgaagatctatgtgaaggcattgaagagcgtgaaggcggcaggcgtgaagattaaggcctgcagccatattacaggtggcggcttctatgagaatatcccaagaatgctctgcgatggagtatgcgcagttgttgaaaaggatagttatccggtaccgcccatctttaagatgcttgcaagggaaggccaaattgaagagcatgctatgtataatacctataatatgggcatcggcatgatggttgctgttgatccggcagatgtggataagaccatggacgcaatgaaagcggcaggagagcagccctatgtggtgggacgcatcgaagcaggagaaaagggagttacgttatgctaaatgtggtcgtgctggtatccggaggcggtacaaatctgcaggcaatcattgatgccatagaatccggaaccattaccaatacaaagattaccggagtgatcagtaacaataagaaggcctatgcgctggaaagagccaggaaccatggaatcgagaatctttgcatatctccgaaggactatgaaaccagggcggtcttcaacgaaaagttcatggaagcggtagatgggatgaatccggacctgatcgtgctggctggattcctggtagtcataccgccaaagatgattgaaaagtacaggaatcggattatcaatattcatccatccctgatcccttccttctgtggtaccgggtattatgggctgaaagtgcatgaggcggcgcttaagcgcggcgtgaaagttgcgggggcgaccgtgcattttgtggatgaggggaccgatacaggcccgatcattctgcagcaggcagtggaggtgcaaagcactgatactccggaagtgcttcaaaggcgcgtgatggagcaggcggaatggaagatacttccgaaggcgatcgatctgattgccaatggaaaggtgacggtgacggatggcatagccagggtcacagatgaaacgacagattaagcgaacgagataagaagaatagaatgatacatacataggaggtccgaaatgaaggttttgattgtcggaagcggcggaagagagcatgcgatcgcatactgtgtcgcaaagagcgataaggtagatgaaatttactgcaccccgggtaacgccggcattgcagaatatgcacagtgcgctcccattggagcaatggaatttgacaagattgtagcatttgccagggaaaaagagattgaccttgtgatcgtaggaatggacgatccgctggtgggcggcctggtagatgaactggaggcggcaggaatccgcgcattcggacccaggaagaacgcggcgatcctggaaggctccaaggcattttccaaggacttgatgaagaaatacaatattccaacggctgcatatgagaattttacggatccgcagaaggcccttgcatatcttgagacagccaaattccccattgtcctgaaggcggacggactggcgctgggaaagggcgtgcttatctgcagcaccctggaagaggccaaagaaggcgtaaagacgattatgctggataagaagtttggctctgcaggcaatgagatggtcatcgaagaattcatgacaggccgcgaagtatccgtcctatcctttgtagacggcaatacgatcaagaccatgacatccgcccaggatcacaagcgggcaggcgatggagacacggggcttaacacgggcggtatgggaaccttttctcccagcccgttctatacgaaagaggtagaggaattctgcaacaaatatgtgtatcaggcaaccgtggatgcgatgaaagcagaaggaaggccctttaagggcgtcatcttctttggactgatgctgacagaggaagggccgaaagtcctggaatacaatgcaagattcggagatccggaagcccaggtggttcttccaagaatgaagaatgatattattgaagtggtggaagcctgcattgacggaacgctggatcaggttgacctggagtttgaggacaatgcagccgtatgcgtcgtcctggccagcgatggatatccggtggagtacaagaagggacttccgatttcaggccttgaggaattcaagaagcatgaaggatactactgcttccatgccggaaccaagtttgacggaggccagatcgtgacgaatggaggacgcgtgctcggtgtgaccgccaaagggaaggatctgaaggaagcaagagaaaatgcctatgcggcgacgcagtgggtgcagttcgaaaacaaatatatgcgtcatgatatcggcaaagcgatagatgaggcgtaagatatagtttggaaataacagcaagagggcaggcgagtctttcgcctgccctcttgctgcataaaagaaaaacagatgactaatagttgcccagctcggccagatagcggtcgatcttcttcaaccttttttcgatccctttcaccttgtggctgatggtatcaagaagcgcttctgcaacgaactgagggcctgtcagtgaattgaagaatgcgttgctgtctaccggaactgtgaagagggtggtggcatactgtgccagaagcgcgcttggcttgtctgtaattacgatgatattcgcgttggcttcctgggccattctggcagtaatcttatcaatagaagaataccttggaaaactgaacataatcaggcagtcatccctggatatgttgcagatgtggtcaatggggctgatggcagaactgttggctgattctacatttggcaccatgtgctttaaatatagcaggaaatagtcgcccaaacatgaattgcctctggaagccgcaacgtatttacgcttgcttgatatgatagtgtcggcagcttcttcaaatgttgcgggagcgttatgaaccagggcggactccagatttttagccgcatttttaaaatgccggttaatataatcggagttgctctcaagttttgctctttttaccacccgctgtgccggtaccgtgatggtactggagatgcttagaaccttatcttgataatcttttctcaaagatttctggaaatccatgaatccgctaaagcccagcgaccggctgaagcggatgacggatgactcgcttacccccaatttcatggctatctcggtggaagtcatgaagcaagcgtcagccgaattgtctaagacatactggccaatcatcttctgcgttttcgtcaaattggcactatggatggtttctctcaattctttcatatgtttacctccggcagaacaggaatatgaaattcccctctcttatttataattagatttaatcatgaaatgaggaaatatgcaagtgcaattgtaaatacaattgacatattcttaacacaattaaaagtttttgtgaaaaaaataacttttattgaataatatagacgggtgtgttagtataattttagagacaaatgaataatattcttcacaaagcaaaagtggtgaaaaatattgttcattcaaagtcgtatgccggaacgaacggcaggcaaaatataattatttaattacaaaccaggaggtaaagtaaagtgaaagtaggatgcgtaaaagaaattaaaaacaatgaattccgtgtaggtatgacacctgataatgttaagagttattcaaacgcaggtcacgatgtttatatcgagaaaggtgctggacttggatctggatttacagatgaagaatatgtagaagctggcgcaaagatgatcgatactgcaaaagaagtatgggatacagttgagatgatgatcaaggttaaagagccattgccagaagagtatccattattccacgaaggactgatcctttatacatatcttcatcttgcagctgataagccgcagacagatgcactcttaaacggaaaagtaaagggtgttgcttacgagacattgatcgagagaaacggaagcattcctcttcttgctccaatgagccagatcgctggacgtcttagtatccaggaaggtgctaagtacttagagaagacatatggcggcgaaggcgttcttcttgccggagtaccaggaacaccaaaggctaacatcgttatccttggcggcggatctgttggaacaaacgcttgcaagattgctgtaggtatgggcgctaacgtaacgatcatggatatcaaccttcagagactggcatatctcgatgacatctttggagcacgtatccagacattagtatctaacgatgcaaatatcgagagagcagttaaagaagctgaccttgttatcggctgcgtgctgattccaggaaaggctgctccgaagatcttcaagaagaaatatctcaaagagatgaagccaggcgctgtatttgtagacgttgctgttgaccagggcggatgcggcgagacaacaaaggttacctatcatgatgatccgatcttcatcgaagaaggcgttgttcattactgcgtaggaaatatgccaggagcagttccgagaacatctacgatcgctctgactaacgctacattaagctatggccttcagatcgcaggcaaaggcttagagcaggcttgcaaggacaatgacgttctgtactctgcaatcaatacatacgatggaaaacttacatgcaagaacgttgcagatagttttgactgctatgagttcgcagatatcaaaggtctgttttaattaattcgacaatttccaaacttaattccttcaaagttgcgaaaggggcttacaatttaggttgtaagctccttttagttgtgttatattatgtgtataacacaacgaatgatggaaaaggtgatactatgctgatagagattgattttaacagtgatgaggcgttatatgtccaactgcagaaccagattattatgggaattgccatggatattatccgggagggcgacgcgcttccttccgtaaggcagatggctgacactgttggcatcaatatgcatacggtaaataaggcatatacgattttgaaacaggaaggatttatccagctggacagaaggaagggagcggttattgccattgatgtggataaggccagggcgcttctggagatgaaggagcagcttcggatactgcttgcaaaaggaagctgcaaggatatttccagagaagaggtacatgctttggtagatgagatatttgacgagtatagaaagggaaagacacaatgaattatacggaacaggcaaatgatgttttgagaattgcgaagaatattgcaaaagaattagatcatccttatgtaggaacagaacacctgcttctaggcttgagaaaagtctatactggagtcgcgggccaggtgctggccataagcggagttgatgaagaaaagatattaaaagtagtggatgaactggtatctccggtgggaagcgttgcgcttgcccataacccggagatcagcccgaggcttgcatatattctggaagagagcaaggcagaagccttgcggtttcagtctagtcagattgggacggagcatatgcttctttcgctgctgcatgagacggactgcgtggccacgagaatactgctgaccttgaatatcagccttcagaagttatatcaggatatcctatctgtccttggcgtggatccgaaagagtatcaggaggaaatgctgcaggagtccggcagaaagaaagaaggggtcgcacagcagtatggaacggatctgaccgcccaggcaaaagaagggaaactggatcctgtcattgggcgggaagaagagattggcaggctgatgcaggtattaagccggaggacgaagaacaatccctgcctggtaggcgagccgggtgttggtaagactgcggtgattgaagggcttgcagccaagatcgcatccggaatcgttccggaaggaatgaaggataagaggatcctgactatggatctggccggtatgattgccggctctaagtaccgcggagaattcgaggaaaggatgaagaagctgatccaggaagtaaaggccgcgggaaatatcatcctgttcctggacgaggttcatacgatcataggtgcgggcggcgcagagggtgctatcgatgcatcgaatatattaaagccatctctcgcaagaggcgagattcagctgattggagccaccacgatcgtagagtatcgcaagtatatcgagaaggatgccgcattggagcggcgttttcagccgattacggtggaagagcctacccaggagcattgcctgaacatactcaaaggcctgcgtacaagatatgaggcgcaccatcatgtacagatagaagaagaggcgcttgaggcggcggtaaagctttccagccgttatattaatgacagattcctgccagataaggcaattgacgtactggatgaggcgtgctctaaagtaagcttaagaggctttaaggtgccggacagtatcttcaccctggaagaatcggtggctgaactgtcgaaagagatggaagaggagatctgccaggggaatatgacagaagcatccttgctaagaaaagagagggatgaggcggcgaataaactagagcagattaagaagcgcttccataaaaggaatgcagacaggacagtggcggtcacggaagaagatattgcaggcgtagtatcccagtggacgaagattccggtgcagaagctggcagaatcagagagcgccagacttaataagctggaacagacgcttcataagagggttgtcgggcaggaagaagcggtatccgcggttgccaaggcaatcaaaagaggaagggtcggactcaaggatcctaagcgtcccattggatcgtttctatttcttggtcctactggcgttggaaagacagaattatccaaggcgctggccgaggctttgtttggaaatgaagacgccatgatccgggttgacatgtcagagtatatggagaagcacagcgtggccaagatgataggctctcctccgggatatgtgggccatgatgatggaggccagttaagcgagcaggtgagacggcatccttattctgtcatcctgtttgacgagattgaaaaggcgcatccggatgtattcaacatcctgctgcaagtgctggatgatggccatatcaccgattcccagggaaggaaagtggacttttgcaatacggtgatcatcatgacatccaatgcaggcgcccaggcaattattgatccgaaaaaactgggattcaatgccaaggaagatgccgcaggggattacaagcggatgaaaagcaacgttatgaatgagatcaagctgatcttccggccggaattcctcaacaggattgatgagatcctggtattccatccgcttgataaggagcagatgaggaagattgtcagcatgatgtgcagagaacttgccagacgcgccaaagaccagctgggcattaaactggaaatcagggattctgtaaagagccatattgttgaaacgggcacagataagaagtatggcgcccgtccgctcagaagggccgtccagaaccagctggaggataaacttgcggaagcactcttaagcggagagattacaagggattctgaagtggcggtcggaatgtctaaaaaagaaataaaatttattccaaagactacaaattaaaattgatttgatatataatagggatacaaaagaagaaccttaggaggaaaaaataatggcagcagtgaaagacctattgaaagcggaagttgatggcacgcttagttttggggactacacactagagaataagacaaagctggatggttttgaatttcagggagatttatataaagtaaagacttttgctgagattacaaagttggaaaagaacggcatgtttgtatatgagtctgtgccgggaacggcggttgaaaactttaaggcgacggaagacatagtaacattcaaggtatctggcatgaaagatgctcagtttactctggaattggaagcagacagcgaatatgtcgtatacatggatgatgtgaatgtaggggatatgaagaccaatttaagcggcaagttaagcgtaagtacggaactggagccaaatcaatccgtagaggtaaaggttgtaaagaagtagcagaatatgagaataaagtcagaagggctgcagatagcagcccttctttcagcataggcgatagcgatcgtaaggagatgaatgatggcaaaggcaaaaaaaagcgtattcttctgccagaattgcgggcatgaagaaagcaagtggctgggacagtgcccagcgtgcagagaatggaatacttttgttgaagagaaggtgacatctgtaaaggctggaaccgtgcgggataagaaggaagcgcagatcgtaactttgtccagcgtggagacggatgaagatgagcgcatgatgacagaaatggcagaacttgaccgggtgcttggaggaggaatcgtaccgggatctctggtgctggtcggaggcgatcctggaatcgggaaatctacgcttcttctgcaggtctgccagaggctggctgctatgaataaaaagatattatatatatcgggagaggaatctttaaagcagatcaagcttagggcaaaccggatgggggatttctcccataccctttttcttctgtgcgagacgaatctggatatgatacgcggcgtgatcgagcagcagacgccggacatggtggtgatcgattcgattcagactatgtataacgaagaagtggggtcagcgccaggaagcgtgtcgcaggtcagagagtctacgaatatcttgatgcagctggccaaggggctaggcatatccatctttatcgtaggacacgtaacgaaagagggtacggttgcaggccccagggtattggaacatatggtggatacagtgctctactttgagggagaccggcatgcgtcctaccgtattctaagagcggtcaagaaccgctttggctcgaccaatgaaataggagtctttgaaatgcagaaaagcggcctcgtggaagtagagaacccttcggaattcatgctgagcggcaggccggaacatgcatccggctccgtagtggcatgtgcaatggaaggaacacgtcctatgctgatggagattcaggcattggtctgcaaaagcagtttcggcatgcccagaaggacggcggcaggcttggactataaccgtgtcaacctgctgatggcagtattggaaaaaagggcaggtttgccgctgtccagttatgatgcctacgtaaatattgccggtggcatccgaatgaatgagccggcagcggatttgggaattgtgatggcgatagcgtccagttataagaataagccggtttcagaagatgctattgtttttggagaagtaggactgagcggggaagtaagggctgttaccatgccggagcagagagtcgcggaggctaagaaactagggtttaagacctgtattcttccggaagtatcggtgaaggggcttggacaggttgaaggaatcgaggtgataggagtcagatctgtaaaccaggcaatgaatctattataaaaggagcaggcttgcagtttcgacaaatctcttacaaaatccagatatgggcggaataaattgtgtaaattgtataaataaaataaaaaataaaaataatattgacaactcaagtaagcatatgatatcctatcaaagttgtcgcggggacataaacaacaaggctagatcagcgagcgacaattattaaaaagattaaaatagttgttgacaagattcgacaaatatgataatctaatatggctgtcgattgagccgcattacagcgacaagatgactgcaaaaaataaaataaaaaagttgttgacaaacgacaaaacatatgataatctaatatggctgtcgaaacacgacaacaacctacagaaccttgataattgaacaatagacaacaaccctgaaaatttcttgtaaagagagaatttcagaacagaacgggacatcgagagatgtccgaccttaaaaacagtaataacgggaaagaattagccaagagttgattctgaccgcgatcacaacttttaacgagagtttgatcctggctcaggatgaacgctggcggcgtgcctaacacatgcaagtcgaacgaagcgcttccgctagattttcttcggagatgaaggcggctgcgactgagtggcggacgggtgagtaacgcgtgggcaacctgccttgcactgggggataacagccagaaatggctgctaataccgcataagaccgaagcgccgcatggcgcagcggccaaagccccggcggtgcaagatgggcccgcgtctgattaggtagttggcggggtaacggcccaccaagccgacgatcagtagccgacctgagagggtgaccggccacattgggactgagacacggcccagactcctacgggaggcagcagtggggaatattgcacaatgggggaaaccctgatgcagcgacgccgcgtgaaggatgaagtatttcggtatgtaaacttctatcagcagggaagaagatgacggtacctgactaagaagccccggctaactacgtgccagcagccgcggtaatacgtagggggcaagcgttatccggatttactgggtgtaaagggagcgtagacggcgatgcaagccagatgtgaaagcccggggctcaaccccgggactgcatttggaactgcgtggctggagtgtcggagaggcaggcggaattcctagtgtagcggtgaaatgcgtagatattaggaggaacaccagtggcgaaggcggcctgctggacgatgactgacgttgaggctcgaaagcgtggggagcaaacaggattagataccctggtagtccacgccgtaaacgatgactactaggtgtcgggtggcaaggccattcggtgccgcagcaaacgcaataagtagtccacctggggagtacgttcgcaagaatgaaactcaaaggaattgacggggacccgcacaagcggtggagcatgtggtttaattcgaagcaacgcgaagaaccttacctgatcttgacatcccgatgccaaagcgcgtaacgcgctctttcttcggaacatcggtgacaggtggtgcatggttgtcgtcagctcgtgtcgtgagatgttgggttaagtcccgcaacgagcgcaacccctatcttcagtagccagcattccggatgggcactctggagagactgccagggacaacctggaggaaggtggggatgacgtcaaatcatcatgccccttatgaccagggctacacacgtgctacaatggcgtaaacaaagggaggcgaacccgcgagggtgggcaaatcccaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagtcagtaacgcccgaagccggtgacccaacccgtatgggagggagccgtcgaaggtgggaccgataactggggtgaagtcgtaacaaggtagccgtatcggaaggtgcggctggatcacctcctttctaaggaaaaagaagaagtaagggctgctgtctattgttcagttatcgaggaatgctggagaagccggcttgctgcgtcagaacagcagggcacggatttcctggcggcgatacgcccgggggcaacacccgttcccatcccgaacacgatggttaaggcccgggcggccgatggtactttactggagacggtacgggagagcaggtggctgccaggatttaaaaaaagagaagggcagatgcagatccgctgcagatgttcgggatcagatagataccggcagggacgggcaacaacccgcagggccgaccccatcagcagggcagtgctgttaagatagctggtcttaccagtgattagaggtcagaagcgcattctggtttctaatggctgataaagcgtcagccgcgcatatgtaccttgaaaaccgcatacatggaaatacaaaatgatcaagaagaatatctagatcaagacatccgaggtaatcgcggaagcgattattcataacaaaccagattcgaggcaacgaatagaaaaaatgccgactggccaacgccggcaacgctatgccgacgtaggacgcaaggcgccgcccgtgcgccgctgtccgcttggtcatgctagaaagagcatatggtggatgccttggcactaagagccgacgaaagacgcgataagctgcgaaaagcttcggggaggggcaaataccctttgatccggaggtgtctgaatggggaaacccgcatgagaagccctcatgcatccctgcgccaatccataacgcagggaggggaacccggcgaactgaaacatctaagtagccggaggaagagaaaacaacaagtgattccgtaagtagcggcgagcgaacacggaagagcccaaaccggggcgcgtgcgccccggggttcggaccgcataattgatccgcgagaggtagcagaacggctttgggaaagccggccagagagggtgaaagccccgtaagcgaaaccgggagcggcaaggcgggatccagagtaccacgagacacgagaaaccttgtgggaagacgcggggaccaccccgcaaggctaaatactccttagtgaccgatagcgcatagtactgtgaaggaacggtgaaaagaaccccgggaggggagtgaaagagaacctgaaaccatatgtttacaagctgtggaaccgctttataggcggaaccgcgtactttttgtagaacggtccggcgagttacgccggctggcaaggttaagggctaaaggcccggagccgaagggaaaccgagtctgaatagggcgagcgagtcagccggagtagacccgaaaccgggtgatctatccatgtccaggttgaagttgccgtaaaaggcaatggaggaccgaacccacatccgttgaaaagggtggggatgaggtgtggataggggagaaattccaatcgaacccggagatagctggttctcctcgaaatagctttagggctagcctcatacgagtcttgcggaggtagagcactgaatttcctagggggcgtcaaagcttaccgaagaatatcaaactccgaatgccgcgtagatgatgtatgggagtcagactgcacgagataagttgggcagtcgaaagggaaagagcccagacctgcggctaaggccccaaaatgtgtgttaagtggaaaaggatgtgggatttcgaagacaactaggatgttggctcagaagcagccatgcattcaaagagtgcgtaatagctcactagtcgagaggtcccgcgccgaaaatgtccggggctgaaacacactgccgaagcccagggatgtacgcagtacatcggtagaggagcattggatgcgggaggaagcggcaccggaaggagccgtggaccgcatcgaagagagaatgccggaatgagtagcgagaggaaggtgggaatccttccggccgaatatccaaggtttccagagtaaagctgatctgctctgggtaagtcggggcctaaggcgagggcgggagccgtagccgatggacaacaggttgagattcctgtaccgcgatatgacagaactgtggggacacgcgtggaaagcataagccgggaatggaaagaccggcgcaagcggggtaggggctgcataggcaaatccgtgcagcgcaacccgaagccgcgacgcgaaccgaactacgagtagggaagtatgcgagccatgcgtcaagaaaagccgctatcgctcatatcgcgcccgtaccgcaaaccgacacaggtagatgaggagagaatcctaaggccgacgggagaagcattgtcaaggaactcggcaaaatgactccgtaacttcgggagaaggagtgccatagagatatggccgcagagaattggcccaagcaactgtttagcaaaaacacaggtctatgcgaagccgcaaggcgaggtatatgggctgacgcctgcccggtgctggaaggttaaggggagaggttagagcgatcgaagccttgaacttaagccccagtaaacggcggccgtaactataacggtcctaaggtagcgaaattccttgtcgggtaagttccgacccgcacgaaaggcgtaatgatttgggcactgtctcgacaatgcacccggtgaaattgaagtaccagtgaagatgctggttacccgcgccaggacggaaagaccccatggagctttactccagcttgatactgggatccggtattgcatgtacaggataggtgggaggctaggaagcgatgacgccagtcgtcgcggagccgctgttgggataccacccttgcagtgctgggtttctaaccagcagccgtgaaccggctgggggacaatgtcaggcggggagtttgactggggcggtcgcctccgaaagggtatcggaggcgctcaaaggtcctctcagaatggtcggaaaccattcgcagagcgcaaaggcagaagagggcttgactgcgacaccgacgggtggagcaggtacgaaagtaggacttagtgatccggtggtataaagtgggattgccatcgctcaacggataaaagctaccctggggataacaggcttatcactcccaagagttcacatcgacggagtggtttggcacctcgatgtcggctcatcgcatcctggggctgaagtaggtcccaagggttgggctgttcgcccattaaagcggtacgcgagctgggttcagaacgtcgtgagacagttcggtccctatccggcgcgggcgcaggatatttgagaggagctgtccttagtacgagaggaccgggatggactggccgctggtggatctgttgcgcctccaggcgcatggcagagtagccaagccgggacgggataaacgctgaaggcatctaagcgtgaagcccccctcgagatgagatatccctggcgacaagccagtaagaccccttgaagacgacgaggtggataggatagaggtggaagtgcagcaatgcatggagctgactattactaatcggtcgagggcatgaccagagaggccggaaggcagaaggaggcccgggtctggggcgttggatggaagtatttcccgtatgcggttttgaaggtatatatgaaaagtccaggaattaatttcctggacttttttgctatttaaaatctttttcataatgaaaagtggaagtttttgtccaattgatatagaaatggtataatacttgtaactatttgggggattgaaaggtattacatatgaagaaaaagaatgagaacggggatatacgcctgattgatgccaataaagcgctggatgactacagcgatatggtgtatcggatcgcgctgcttcatatgaagaataagagcgacgcggaggatatatttcaagaagtatttctaaggctggtcagatatgctgacaggataaaaggagaggaacatctgaagcactggctgatcagggtgacgattaactgctgcaagaagcagtttgataatgcgtatagaaagaggacggttccattagaggctgatggcaggaaggaaccgtcttatgagatgcctgagcaagatgatagcatctgggaagccgtgagacaacttccggataactacagcagcgtcatccatctgttctactacgaacagtattcaataaaagagatagggcagattatggaattatctgacaccgcagttaagacgaggctgtcccgcgcaagggatatgctgcgtgactatttggaaggagggcaaggctgtgcaggatcacgataaggattatgacaactttgagaaaagatataaagatgaagtcagccagattcgtgctcccagggatttggttgagcgaaccaggactgcaatgcaggcagaggcttcgacattttgcaggaacgagaaagagccagatcaaatggctgaagatcagaacaggaaaaagaaacagtacatgcgcagatggatccctgccatagcagccgcctgcatatgcattgtcatactgggcgtatatggaggctatcggtattacgctggaaatcatatcaatgtaggagacatcgtattaagccagtctgatgacaatggatgggaaataggagtagagcttggcaggatggatccgaagcaggaggaagactcgccagtgcagatcgtgtccgggaacgaaagaagtattgcgccgaaacagttgtgggagattaagccaagcatgatagaaggacaggaggtacatataggcacggatcagaataaaggaacttattatgcagcctgggaaaaagaagggacttattattacgcatcctccaattctacgaaggaagaaaaatttctggattatttgaaaaaaaatataaaaaaactgtaaccttagcggtctatgcaaggtattcataatagaaaccatacaatggagggtgatacatgaaagagaaaagacgaagacaggctgtcagccttttcctggtattggcgatactgatgacgggctgccagggaaagcagcaggcacaagatagccaagaacgcagcggagagaagatcgaggccgggaaacttgcccaaagtgtccgtgataaatatgcggatgaagaaaaatatgagtacggcgagccgattacggatatcgcaagagatgagcatctgaagattcagatgggatttgacatcatgaatgcaggatttgaccagtatactcagatcgtccaggtatttcagaatgcggaacttacccagagcgttggaaccggatttgagtgggatgaagaaaagcaggtgatatccatcacccctccgaagtggagcgcaggcggtatcagcaatgcggaactggacaaggatgtgccgggaaataaatctacttcaacggaactgtttgataaaggcgaatcaaaggattggggcaacctccctcagtactatttggtgcagtatgtagaccttgagacaggagaaactctggcgaagccgatcgttacaattgttactgtagaccatgaggtgaaaaaggcaccaaaagtgtcgctgcggatcggcgaggacgggctgcctgaattctcctggaagaaggtgccgggagcggatacctattatattatggagatgaattattctaaggagtccggattcagcggcgcgggatgggtacagggacatacaaagaagacaaagtggaagcccgaatcagcgacacatctggtgacctttactgtctccgaagcccaacgcatcgaggactacaatattgaaaagtatggagagggcacagatccgattccaaaagacggagtctacgaaacatattattgcgtgatcgctgcttccaaagatggcacatccgcgatcagcaatacatttaatgaaaaagagatcgcaaggcgcgtcccctattcagaagaagtagggatcagcagggaaaaagaaggatcaaactatgcggatggatttgcgaatatgccgtcatataagtgggtgaccatgtgtgatggcaccttggtacagaaaatgatcaattatgatttccaggaagcggaaaaggtagtggagacttggggagaatatgagaaagaagatatgtccgatctccataacgtggaagtagacgtcgtaagggttccttatgtaatagagggaaccggattcaccggaatcgtgaaggtccagaactttaacagcgagacctgggaaaaggatttgaaagaaatagaaaagcggcaggagcagctgcgaaaccgggcaggcgccagggatatcgagattgaggaagcacagacagaggacgaggctggaggggatagtcagaacgtctatgagacggattataagattacagccaacagcgcgttaagcgaatatcttgcagccaatatgctgacgggcgcttcgatgatagacttaagcgacttcccggagagcgcggatcagcagtatctatccgatgcctggatggaggcggtctaccagaacccactgattcttggagtcaagagcgcaggcatcgctgatggcggaaagacgcttatggtacagtacgatacggacccggcggcaatggaagaaaagcagaaagaaattgcagaagaggtaaaaagggtcacaggagagatcattacggacgatatgtccgaactggacaaggaactggcgatcaaccaatatctctgcgatacggctgaatatgatatggatgctcttgataatgccgagaagaataattttgaaacggtagatgagcagtttaatgattctttcaccccatatggcgtactactgaataagtcaggcgtgtgcgcaagctatgcgggggcttttaaacttctggcagatgaggcgggattagagagtatcgtagtgacaggcaatctggagggagaacttcctcatgcctggaataagataaagattgacggagaatggcagattgttgacagcacgaataatgacaatgagcttatctttaacgcgctgctgaatcttccggataaggcggctggcaaggtgctggtagaggatgacagatatgtgctggataccaggatagcacattaccaggcgccgacagataagatggagtattaccggcttcagaataaatatttccaaaaagaccagatagcagattcgcttacggcagaattaaagaaaggcaatgcggccgtacttcgtacagattacgatctgaacgaccagcagttcaatgatattgccatgaaggtgcttgaggaatacgggaatgatgatcttgccggatactactggatgggagtcatatatctgacggaccaggaataataaaactcacggagggaaaagagatgaagaaaaagttaacagcaacagttacagcagcagccttgattctaacagtcgcagtaagcgcggccggctgcggaaaaaaggctacgccagagaaccttttgacagacttgaacaaaaatattaagaaagtagagtctgtttctgggaatatgaagatgacggcatccatgggagatgacacgggttctgccggcatgtccatggatgtgaatatggagtcaaccaggaagccggcggccacccatatggatggagaattttccatcaaatataatggctcagatatcaatacgacgatcgaggcatatgcgctgatagaagatgatgaagtggttacttacacgaatacgaatgaagcatggtcaaaaagcacttcggatgacgtagaggatgcgctggacatcaatgcatttgaaaatcttaccaagacccacgagtcgtttaaaaagaaagaagatctggtaaaggtaaatgataaggaatgctttgaactgaccgggaaaattggaggaaaatacctggaaggaatcatggatgaagatatggtgaattcttttggctcttccggagatatcctggatgaagaaaaaatggaaaaagccaagattccatgtaccatagacatttacaaggacagtattcttcctgcgaagatccatattgatctgaaagatctcgtacagaagtcttatgccgatagctaccagaatcttgaagtagaagattactttgtggaaatcacatattttgaatatgataacataaaggagatcaaggttccaaaggaggcattggaagcgaccaaaggaagcgatacggataaagacgatcaggatgacgataaatctgctaagagtaagaaggctaccccggcaaagcagagcagcgagttgaaggataactgggacagttatacggttcagataaatgacaaggttctaacgctgccatgtgagattaaggatctggaagcagcaggacttgccctggatacggaggatacggctgaggattatgtcgtgaatgcgggcgagtacgagtttgtcttttttaagaacgactcaggcgcatccgtgatgatagacatgatcaaccagacagacagtccttgcaaaattaccgaatgcatggtaggagggatcacggtaaatgaatatgatctggaggatggaactttgtccgtgatcttcccgggaggaatccagattggaggcgctaaggcagatgttctgtcaaaatatggcgagacgcaagacgtatattccgatgagaatttccagatgtacacttggaaagatgctgatccggagaaatattataacagttgtatgatagaatttgatgcgccgactgaaaccatatatgagatgcagatgcagtgctatgagtaggcactgccagcaagaacaagactgaataagagcgaataaggagcacgcggcaagatttgcgcgtgctccttattcgctgtccgttatctaagattcctgcctgagttctaagatatgattgacaagcagcgtggcaacatcatccttgctcatcagttccagttctgttacagaacccggagtgatcatggtgacaatattggtgtcggcctcaaatccggctcccttcacctttagattattggcgatgatcatatccagattctttttcaccagtttcttcttggaattctccagcatattctcggtttccatagagaatccgcagaggaactggccgggctttttgttatcgcccaggaatttcagaatatcgtccgtgcgctccagcgggatgctaagttcggcatccgatttcttgaccttttcatctgcaacctgggatggacggtaatcggcaacagcagcagccttgatgataatatccatatcccggcttctggaagtgacggcttcgaacatgtctctggcagaaatgacaggaaccacatcgacgaacatcggcggatctatagcggttttgccggttaccagcgtaacctgggctccccttagcatacagtccctcgcaatactgtatcccatctttcccgaagagtggttggtaatgtacctgacaggatcgatggcttcctgggtaggcccggcggtaacgagaacctttaagcccagcatgtctttggggcaggcgcagcatctgtaaatgtgctggaggatggtttcaggctccggcatcttccctgctccggtatctccgcatgccagccttccgctggcaggatctatgatttccataccgtactttctcaacgcctccaggttgttctgggttaccgcattctcatacattgccgtattcatcgccggcacgatgatcttaggacatttgcaggccaggaaggtagttgtcagcatgtcttcagccataccatgggcaatcttggcaatcacattggcagttgccggggcgattacgaaagcgtccgccttctgggcaagagcaacatgctcaacctggaattcaaaattcctgtcaaatgtatcgattacgcagcggttgccagtgagcgtctcaaaggtaatcggcgtaataaagtttgtagcatgctcggtcataagcacatggacctcggcttgggatttgaccagcatgctggccaggctggcgcttttatatgctgcaattcctccggtaacgcccaggaggatcgtttttccttttaacatagtaagatttcctttctgtagtggttttcatattactataactataacctgttttgggacgtgttgcaagaagtcctgtgtgaaaagggtgctccatcatcagttcaggcgttcgctgcctaataatattctaatagacatggggcatagaatagagtaaaatatgaaacaaaaacaacggtagccatgacaacgccagacttccttccgtatctggctcaatctcaattgggaaacgccccggattgtccgggaaaggaaaaggatatgggtattgatatgggcccgcataaagggcatgtgccggattcggccatcatcaataaaagacgatacgtgagggcggggaattttacagcgaaaatcaaggaagatcgctggatagctgatttgcccggcaggcctcttctgcaccctcgtatttcttcgctgccaagtcaggaatgtgggggtgaactatgagagagtatgaaatccttatgctgctgcgggaagcataccgctttattgggcgtgaaaacagaaggggatatcagcgttgcatggagcaggctaaggctgctatcgatgctatgccaaagagtcgtgcgctccggggcgaatggctgcttatatccgcgatttcctgtccttcggatttagaccgtctctgcgtcctcttccgggaagcagcagagctgatggaaggacattcccgcgttctgccgcattgcgcgccgctgtatgatgactatggcgcgtttgctgtctgcaataaacagcctggtcatgctgaggaaaatatagagaaactggctgaggcagttcggctgttctatggtttgacgggcggcgcaatggcaacagacgtgtgttatcgcgcccaggtcgctcattatcaaggcaagatagccgaggcccggacgctggcaaaggaagcgttcgaactgtcacaacagcagggacttgtggcgttatgggccgcctatatactggccgacctcgcaaagcaccagctggacagcagattgtggagttttgcctatgggtatataaacgccgtggcaaaagggatacgcaaggctgatcgctgcagtagagagcaggcgctgatgttttcctgtctgctggatatgtcgctgggccttttgcacagcgtcccggactgggtaaaggctggtgactttggaatcatatccacttcatggggctacgaacttgtcgaggacaaggtccttcgcggaaccctcgtcccggccctggtggcccggctggaatattactgttactgcgcccagccagtgaaggcgctgaacattgccgatacaatacaaaaggtatacggcatggggaacgttgaactggacgcttacctagagtttttccgggcaggcagttatgcttacatgggcgatgccgatcgggtgcgtaaagccctgatgcgggcagtagaacttcttgctccggacggcctgtggctgattgccgctgaatttgaaccatcctttggagaacttcttcatgaagtcgccaatcgggtagaccgggaaggagcaatccaaattcggaagatcggcgcgggtttctgggaaaagcttgcgccgcttcgggaagaacttctgcttaaaacttccgtcggattgacaaagcgggagcgggaagtcgccgcgctgctggtagagggaagaaccaacagtgagatcgccgcagcattgtccatcagcgagcgaacagtgaagggccatctgactaatattttcaggaagtacaatatttcgcggcgtacccaggtggcgagggccatggaacaggacggaaaaatagaactggctgcctggatcacttgagtttttgtaaaaatcaatacctttgtacggtatgtaaaattaaaatctatgttaaacttataaggtagaatgtggattttaatctgtatagaaaaggaaaggtacaagcaaatgataaagaatacaaagaaaaaactgctgacaatagtggtgtgcctattcgcagttttgtctgcaatgccgcctttaaaggcctctgcgctgaacatggaggaaggaactccggagctaataataaatacgcataccgtaagttttgcgggaaccgaatggtgggtcgtaggaacgaagacgctcgggggcgtccatgtgcaagaggactgcattactcttttagaaaagaatggtacctttggcaatacggcattccgtacaggggctgatacgcagaatcagccggactggaaagagtttgtctatgacggatcattctataatggatggtactatgagggtgactttacagatcctaatgattatgcggacagcaccttgcagcgcagtatagaaaagatggcaaatcagtatccatcttccaaagaacaaacgttgattaagcccaggacagaattatctgaaggcatcaatgatcagaaaatgtgggctttgtcctatgatgagtttttatattttagtggtacagatgcggcaccctataaaaaatcatggtggcttcggtcgccggggcgcggcataccgagcgctggccccgtgtttgctactacggtggccccaacgggagactctatcaactatacgaacgtagattttgatggacaccatgggatacgcccggcactcaatatggactgttccactgttcaatatacggctgacagccttgctaaggcagcggttacagtcagcgatggctttatccctacatcggaaataggtgcttccggaaatgcgctgaaatttactatgcaagacagttcgctgcgattaagtatgaatgccactgatgcgcaaaaaacacagagcggctcgacgctgcagttcccttattccagagcgaccacaggcgagcaccagtacatttcctgcgtactgacggataatacaggggtaaaatattatgccaggctggcggacactgcacagagcgaagagggttctctggcaattcctctttcaggagtggccgatgggacatacacattaaagattttttcagagcaggtcaatgatgctaattacacagatttctcgggtacgccgaccacgatgaccttaaaggtgaatcagggagaaggtacagtgagtgattttaaaacagagcatatgcattcttggagcaaggactggagctcggatgataaataccattggcacgactgcgatgaagcggcatgccccattactgataacagcgagaaggaaggatatgcagaacatacatggcaggacagatccgatgcggacaagcattggcaggaatgcagcgtatgcggaaagaagcgcgatgagggcgtgcacagttatggcgattggcagaccattaaggaggcgactgcagtcgaggcaggaagcagagaaagagtctgctcggtatgtggctataaggagacggagccgattccgaaaattgtaacgccagcaaagcctactgtagaaaacaaggcgccagagacgggagatgatagcttgacgtgggtttgggccgctctttttgcggcaggcggattgtctgtttctattctttggatcaggagaagaaaatacagtaaattttaatccataaagaaccagtattttaccgggctcgatgaaacgggtccggtttatttttttacaaattgagaatggcaatataactttgagccttatattgccaggcatctatggaaaagagttgcttaatattaggctgggtgttataattacagcgtaattgtattgtatcctgcacagcaggaatgataacaaggaggaattgaataatgaagacaaagaaacacgacacacgttggatggtcagtgttgcacttatggcagccattgtcatcgtgctggcgaacacgccgctggggatgattcaactgccgattattaaggcgacaactgtacacattccggtaattatcggagcgattctgttaggcccatcagcgggagcaatcctgggcgccgtatttggcgtatgctcattgatcagcaatacgatggcgccaacgcttttatcctttgcattctctccatttatgagtactacagggataccgggagcattaaaggcaatctggatttcagtaggatgcaggattttgattggagtagtggcaggatggctatggattttactgagcaagttaaaggtaagccaggtgatagcgcttccaatcgtaggattcatcgggtcaatggtgaatacggtggcggttatgggaagcatctacctgttattcgcccagcagtatgcgcaggccagggaagtaggcgtgaccgcggtgtggggcctgattatgggaacggtgactgcatcgggaataccagaggcaattgcggcagcagtgctggtactggcgttaggcaaagtactgattcaggtatttaagaagatgaacattggaatgatgagcactcagctagcaaagtaagaagttaagataaaaaaatcaagtgccagagcaatctggcacttgacaattatatagtaaatatggtataaatatctagtgcgacagataatgccgcagatatataggggattggtcaagtggtatgataggggtctccaaaacctttggcgggggttcgattccctcatcccctggttcaaaaaagaagcaccggaaactttgcttacagcaaggattcaggtgcttctttgattttgcagaaataaacctgcagggaatggttattctatctttaggtgacagttggagggaagaatcagaaaggcaggaatacgaatgtcatattacagttatcacgggatggcaaagaagcttatcaaagaggggcatttgatcaagtatgagatcgtcgaagactggaacggaatcaggccggcactggtactgtattttgacaatcacaggccaatgccggtaagagccggaagatgggatgaatattgggagatgctatcctcctaaggaatatttttctcggcaggaatgaagaaagtatgcggacactccaaaggtaagcagttcggcaacgggaaccgccagccacacgccatttactccgatgagcgcaggaaggatgagcaggcatagcatgatcaatccaaaggttctgaaaaaagagatcagggctgatatcctgccattggataaagcagtaaatgtggcagaggaaaagatattcatgccggagaacaggaaactgaaggaaaagagtacaaatccgggcgcagcaatgtcatataccagagtttccgaaccagcgaaaagatgtaccagccttgggccaaaaagcagagaggaaaggaatatgcaggcagagctgacagcgatgaatctcaggcagatcctacagatattctttagccgcaggaggtttccggcaccatagttgaagctgatgactggcgcgacgcccatggaaaatccaatataaagagtggtcagcaggaactgggcatatataatgatcgttatggcggcaactccattttcacccagcatcttcagcatggcgcggttgaagaaaaaagtggtgactgcggaggagatctggctgaccatttcggaagagccgttggcacagcttttggccagaaccgagaggcgaagggatggccttacaaaggataaggtgccatttttgccgctgaaaaacagaattccgatgcttgccgggatcacataaccaattcctgttcccagtgcggcgcccatgacgcccatacccaggactgccataaaaagatagtctaaaatgatgttgataatacctgcgccgacagatagagacaggccaagcgagggtcttccggctgtgacggtcagattctggaacaaggtctgcagcatgcttgctggggcaaataatagcagaatccgtagataatctttacagtaagggaacagcatgtcggtggctcccagcccccatatgatatggtccaaaaagaaaaggcctgtgacggcgaccagaattcccaggaacgcgccaaacaatacgatcaaagtaaagtcctgctttgcctgcctctcctggccttcgcccatcctgcgggcgataatggcgctgccgccagttgctgtcattgtccccaggcctaccatgatattaatgacagggcagacgatgttgacggctgagagcgcatttgtgtttacaagtctggatatgaagatcgtatcagtcatggtgtacagtcccatgaagagcatggtggcgattgtgggaaaggcgaagcgaagcaggggaatcagcgtaaaatcctgcgccataggatttccaggcgttctagggcgcgtcatcggtattgcctcctgcctctttcgcaagtataagcctctgcgtaggatagccgaattctgtcagtagttctgcttctgcaaatcccagattcagataggcatcccggtagccagtgtccgccttgtccccttcgcggaaggtggtgatagagatgcttcggtcagccagaagctcattcataagcttatcaaggaacagccgggcaatattggagttccgataaagaggatgaactccaaaaaaatcaatgctgcccgtgttatggcttatggtcattaccgcaacagcgattccttcgctttttaagatcagcgcctgctttttgcggatatattcttttagagtcataagatattcggattcgttcagatggggaaatccgtctacgaccagatggaccaggtccatccatacagggatatcttccgctgtggcaaaggaaatattctcttttgcatccatcatcgtatggttctgaggcgaccctgccttcaaatcaaactttaactgcaagggatagaactcttcatctgaccggtattcgttgggcgattttttatacatctgccggaagatattcgtaaaagcctgctggctctcatatccggagattaaggcaatctccagtataggcctgtcagagaaaacaagcagtttggcggcttctgtcaattgcctgcgctggacataatcgtggatggagagtcccacggtatcggagaatatccggtgcagatggtattttgaatatccaaccgatttggcgatagaagataaggtcaatttctcgctcaaatgttcttctatataattgatgactgatataatgttttctactttgttcatcttttcaaacctccttactagtaagattatagacaattattaagcaggtgttttaatagatgttgcggtttttcctatataaatattgaaaaagagtcatattcttccatgcttgtctatataataatactacatagccgcgataaggaaagagtaattccgtacggtcaaatattatggcaaagaggagatttgtgggatggcaagatgcaagaaatcgtatgaggatcaattaaaggcagtagaagaacagatagcaaaggtacaggagaaactcaatcatctcaaagaacagcgcgaaaatatcctgtcaaaaaagcgagaggaagagttggcagaactataccaggtgcttcaggaaaatgaacttacggtagatgacgtgttaggcatgcttcaggaaagcgaggcacagacagcataagtcggggaacggggcaagagagtcaaatcttttgccctgtttttgtatatgcatggaaaaactatcaatgatataaatttgacatcccagcttattgtccttacaatgaagatataaaagtactaaagagagtgaaagagaagatgaaaaaacagaagaagaatccattatataaaagtttccgctatgcattcgaaggaattattgcagggatcaaaaaggagcggaatatgaagatccactgcatggcgatggttctggtcattgcagcgggaatcatcttgaaactatccataacagagtggtgcatctgccttgtgctctttggagtaatacttgcgctggaactggtcaatactgccatagaggcggtggttgacctggtaacggaggagtacaggcctttggcaaaattggctaaggatacggcagcaggcgcagtcttgatcgcgtcgataatggctgcaggggcgggaatcttgatcttccttcccaaggtcctgagacttgtgggagcgctttgatttgcggggatgcatagatgcataaaatggtgtagaataatagagaacaaggaaacaggttttattaacagaagacagaaaggggacatgcagcatggagaaactgggagatggcgtaaagaaggtactgctggctggcatcggagcagtcgccgtgacagccgaaaagtctagggaactactggatgagatggtaaaaaagggagaacttaccgtagagcaaggaaaggttctcaatgaggaactgaagcataatattaaaaagacggtgaaggaaaatgtcaatgtttcgatcaagccgtcttctgccgaggaactggaagaactggtaagccagatgacgccggagcagcttgccgggctgaaagagcagattgcaagaaaagaggcagaagttaaagccgatgtaagcgaagaaactgacggagcaaaggatgagtaaaaaggaatcaggcgaatacggtgcccggttaagggagatgacctctgtactgcacaagcacggcataaccagaggagtgactccggagaaactccggctgatactggaggatctgggaccaacttttattaagctggggcagattatgtctatgcattcggacatcctgcccaaacggtactgtgatgaattgatgcggctgcagtctgaagtgacgccgatgccctttgaggaagtggcagaagtaatcgagggagcatatggctgcccatggaaggaaatatttctcgagatcgaggacacgcctcttggatcagcctctatcgcgcaggtgcacaaggccgtactgggcaatggatgcaaagtcgtggtgaaggttcagcgcaagggaatctatgagacgatggcaagggatatcagcctcctccacaaagcagtaaagcttctgccgccggtcagcctcaaaggcgtggtggatctggacatggttttggatgaattgtgggcggtaacgcgcgaggagatgaatttcctgacagaagcggcaaatatggaagagtttgcccgcagaaatgaaggaattgcctacatcggcacccctgtgctctaccaggaatatacaacgcttcacgtgctggtcatggagtatatcgaaggatacaggctggatgaaaatgaggcgcttatcgataatggatatgacttgaaagagattggcagcaagctggtagacaactatatcaagcaggtgatggaagatgggttcttccatgcggatcctcattcaggcaacgttaagatacgggatgggaagatcatctggattgatatgggcatgatgggacgcctcactgagcgggaccgcgagctgatcgggaatgcggtgcagggaatcgcgttaaatgatatcgggatgatacaagaagcggtgctcgcactgggagaattcaaagagaagccagatcagaacaggctatataaggatattgacggcctgcttcttaagtatggcaacgttgatatgggaaagattaacgtggcagaggtcatgacggacctcatggacgtcatgaaggaaaataagattgccatgccccatggcctgacgatgcttgccagaggcctgacgcatatggaaggcgtgcttgcaagcctgtcaccggatatcaatatggtggagattgcttccgctcatatggctggcgaagtcttaaggaataaggactggaagaaggaagcaaaggccgggggaaggagcctttaccggtcattgaagaaggcattggatatcccggcgctgacggcggatatcatgcatggctacttaaaagggcagacaagggtcaacctggatctgcatgcggcggatgatctggccctgcttcttaggcgtctggtccgcaatattgtgatggggctatgggtaatggcgctgctgatcagttccagcatcatatgtacgacggatatgtcgcctaagatctgggggattcccgcgctgggagcctttggctatctgatggcctttgggattgtcatgtatgtatttttaaaacatattttttcgaaaaagtaaaggatgcaaggggaaggatattcccctgcatccttttttttgcaagcggatcattactggcagtatttttccatatcttcttcgaagtcggcgatctgcctggcaagggactctctgtgcgcatcagtcagggccgccgtaagagctgccatattctcttcgatctgggcagggttataaggaatatccagggcaaaatcgctgaatgcgcgtatcttctgaaaatacatattcgtatcaggctcctcatggccgtttctgcacatgtggtacatagtaacgcagtcggttgcctcggtatctgtacattccttgcagatccattttcccagataataatatcttcccccaatatcatataagaatccggggagttttaataatttttccaccatcattgaacgatacctccttcatctaaatacaacagtagcaaatacgacgggaaaaagcaagctttttggcttctaaagtgaatttttaggatagtctttttctggataatagtgtacaattaaagcagtgagattttgtaagtcaagactcagagcagacgtaaggagaagacgatggaaaatgcacggcatacgatgctattagtagatgatacagagattaatcttgacattctggaagggatttttgaggctgattttattatattaaaggcactgaatggaaagcaggcgttgaaggtcttgaaatcacagaaggttgatattgtcatattggatgttgttatgccggagatggatggctttggggtactggaggcaatgaaggaagatcctgcgcttgcggacatcccggtgatcatagcgacagcggacgaaggcgagaatgaggaaagggcgctgcttaacggcgccgatgattttatcaagaagccatataatccagtagctgtttataagcgtgtggaaaatattctggttaagcacgtgctggagcgggagaagttaaaagatgccctgaataattccaagatggaatttcaatccctggcagacagcgtgccgggaggaatcagcgtatggaaggcggaagataagataagcgtccgctactataatgatggatggtgcgagcttatggggtgtaccccggagaggtttgccgagaagtacgcggaagacctgtccaaggtcatctatcctccggaccgcgagagggtgatgggggcgctgctggcagacagcaagccgggaagaagcgtgcacttggagcataggatcgtgagagacgaccaagaggtaagatgggtcaatctctcagcagtacattacaagacggaagatggcgccccgatctaccgggcagtggatatcgacgttacctccagcaaggagaatgagatcctggcggagcagcggaacgtggagttgcggcatatattggagcatgactcgcttacggatgtatataaccgttatgggttctgcaccaggacatcaagttttctcaaagaccatccggatgagaagtatgtgatcatgcagctggacattgagcggtttaaggttgtcaatgaattatatggcattgatgtaggagataaggtgctgtgtactctggctgagtgcctgaagaagcatctggaaggcatcggagtatttggaaggtttgaggcggaccattttgtaatgtgcataccggatgacagggagttccaggagcatgtacgtaccacgcttcagagtcagatggccgatatggggctgcgtcatgagattgacttatattttggaatctatccgattacggacagggacatgtcggtagaattaatgtgtgaccgggcgcaattggcgctggagagcattaaaggaaactacaatcagaattatatcatatatgatgatatcatgaaccagaaggttcttctggaacaggagatcactaatgagatggagtgggcgctggagggcggccagttccaagtatatatacagccgatctacagcctgaaggaaaactgtctggtaagcgctgaggcgctggttcgctggttccatcccgaaaagggaatgatatctccaggagactttatcccattttttgagaaaaatggctttattgtcaaactggatgcttatgtaagggaaaaggtggttgaattgctggctgctgtcaagaagcagggaaagagaagcgttccggtgtctgtcaatctgtccagactggaactatatgaccctgatttttgcaacaagctggtaggcctgattgagaattatcaggtaagcccggaatatctaaggctggaaatcacagagagcgcttataccgataacccgcagcagttgctggatactataggagttctgcggaagtatggatttgatatattgatggatgattttggcagcgggtattcttctttgaatatgctaaaagaagtgccggtagatattctgaagctggacatgcgtttccttgcgggaaatgatgtgtttggaagggaagccagcattctggcatccatcgtgcacatggctcatgatatcggaatggctacggttgccgaaggaatagagacggaagagcaggcaagctttttaaagaagatcgcctgcgaatatgggcaaggctactactattcgagaccgatcccaagcgagaagtttcttgaattgctggattccgggacgcatgccgaaggcaggcgggcctctggcagcaaggcttaggaatcagaggtacatatatggggacggataaagaggaagttttgggaaaaggtatttttgaatccattttagagcagatgaacgccaatatatttatcatggatgcacagaccggcatcattgtttttatgaatgaaatgatgaagagggactttggcattaaggaggcggaaggcagacgctgctttgaagtcctgcagagaggaatgacgcagaggtgctgcttctgcaagcgggataagctgctgaagatgtgggaggcaggagaagaggccggcattacctggatagaggagaatacgctggatggacgcagttataagaatcatgaccgcctgattccgtctcaaggaaggctgtatcatgtacagtactctacagatatgacggaattaatgagactgtccaagaacgcagccatggatgaattgacgaaggttctgaaccgaagagcgggaaaagagcggctggacctgatgctggagcaatccaggaaggaagagaggcccctctgcgttgtcctgcttgatatcaatcagctgaagacaattaatgataattatggccacatcgaaggcgacaggctgctaaaatatgtgacctgcctcgcaaaagaatctataggggaagaagatatgatcttccggcttagcggggacgaatttgtaatcgcatactatggcgaagatatattagggacggaagaacgaatgaggctgatacagaaggagatcgataaaaggagggaggaattctccatcttttatccggtgtccttcagttatggcgcgatccaggtgtatccaagcgacactatgagcgtctcggatatattggggaaagcggatgagcagatgtatgtccagaagcggcaataccatattatgcaggcgaagagcaggctggagggaatggagtgcagcaagggacaggcggctgattttgaatatgacaaagaacatctttatgaagcgctgatcgccggaacggatgattatatatttgtaggaaatatgaagacaggcgtattccggtatccgccgaagatggtcgaagagttcggcctgccaggcgaagttgtagagaatgcggcggccttctggggcgaattgatccatccgcatgacgagcagtattttctggagagcaaccaggaaattgcagatggaagggccagctaccataatatagaataccgtgcaaggaatatccggggggaatgggtctggctaagatgcaggggcaagatgattcccgatgagtatggggagccgggcttatttgccggcatgattaccaatcttgggaaaaagaaccagattgatcatatgacaggcctgtataaccggtttaagctggaaggcgatgtaaaaaaacagctggcagatggcgacagcagcatgaagttcggtattatgattcttgatatggattcgtttcataatatcaacgatctgtacaaccgatcctatggagatgagatactgcgtattgccgggcagaggatatcctctatcattccacccaatgcaaaggcatacaggctggatggagatgaattcggggtattggttcttggcggggagaagcaggagtgcttaagcatatatggaaagatacagaacgcgtatcagaagcagcaggaatataatggaagaaagtactattgcacgatttcggcaggatgcgtgttctatccccaggacgcagacaattatctggacttgatgaagtatgcgaattattcgctggaagcgtccaaggatgctggtaaaaacagaatgaccatattttcgggcagccttctggcggagagggagagaagcctgggactgatggaagaattaagggaatgcgtagagagaggatttgccggttttgcaatttattatcagccgcagatcgtggtggatacgcaggaactatacggggcagaggccctagccagatggaaaagcgcaaaatacggcaatgtatccccggtcgagttcatcccccttctggaaaagagcgggctgattatagaattcggcgcatggattttttatcatgcagcgatgcagtgcaagaaatggatggagcacagaaacaatttccaaatgagcgtaaatctatcgtatctgcagcttttggaaggagatattgtggagtatatgcaggagacgctggaatctctgggactgaatccacagcgcattacgatggagctgacagagacttatctggtaaaagcagacgcggatgtgcttggcacgatggaaagaatgcggatgatgggcgtaaggattgccatggatgattttggcgtaggatattcatccctgcattctcttaagaatatgccggtagatcttgtaaagattgacaggggattcgtaaaggggattgacggagatatttttaacgcaacccttatccgttccatcacggagttatgccatgatgtggggaaaacggtctgcctggaaggagtagagataggggcagagtatgaggtggtccgggatatgggactggaactgatccagggatactactatgggaggccggtaccggccgatgaatttgagaaacagttcttttgatataggaagtgtaaaagcggcgggaaagtacgaggataagaaaatccggtattttcccgccgcttgctttttgcgcctatatagataggttcttccggctgaaatgcacgattgcgatcaggtagccaagaagcccgatggcatacaggatcaggcatccgagaaaggcttcgcttttggaggcggccaggccgtctggatcaaagagtgtaagcggcgtagcgtattttagattctcaaatttgtcccctacctgggaaatcatctgcaccaggagggagtacacgacgactgcagacgatgctcctgtgcagtatctgctttcattaaaaaggcaggaaaagaagaagcagattccgccaaaaaagaggaacaatccgaaaagcccgacatttacccgcaggaaggcggccttttccaactcgccgggaaagagcgcttcgctaacgataagtatcaagagagtgacatatactgccatcgcaagaaggcaggcgaccatgaaaaaggcctgcgtccctgccagcttgcttcgcttatgcggaacggacagcaaatatgccatagagccattgtctacatatcttgcaataaggcggttggacagaagtatgatgaagactcctggaaacgctgtaaacagtatgccatataaatagcctatgatagactccagcagcgtcgttcctacatctgccattccaaacgcagaaaacagctggggcatgctctcggccatggcccgcaggctgtcgccaagcttagggtcgaacatggcaatgatcatgcaggaatacatgcttaaaacggcgagaaatatgagaagcagtatatagttggatttgaattctttttttaataaggtcgtgttaatcatcttccttccctccataaaaatgcatgaatatttcttccagcgactgggtctttatatccagatcagccacaggatactcggaagccagcttaaccaaggcatccatattgcccttcaccttgacggtgaccgattcctcgttctggcgggcagaaggcattctggatgcaaagtcccgggccgtatccgcggaagggaattgtaattctacgatcttacgcttgttctggcgaagtttttctatatcctccaccgccgccagacgtccttcgcgtatgatggccgcccggtcgcaggtacgctccacctcttcaaagatgtgagaggacagaaggatcgtcttgcccttcttcttctcgtcaagaatcagatcgatgaaggcgctttgcatcagaggatccaggccactggtgggctcatccagtaaaaggatgtcaggatcctgcataaaagcgcatacgatacctattttctgcttggttcctttggacattttcttgatcttgggagaaggatccagttcgaaccgctccatcagctgatgggcgcggccaagttccttcatgcccttcatccgcgcaatgaaacggatgaattccatgccagtcatagagtcgatgaatgcgatctccccgggtagataaccaacaaagcgcgcgatctggtccgcctccttgaagcagtcttttcccagaatcaagaccttgcctttgtcaggctttaggaatcccatcagctggcggatggtagtggtctttccggcgccgttgggaccgaggaagcccaggacttccccgcgctttacctggaaggcaatgtcaaagacgccccggccgccgccgtaatctttggttatatcctgaatgtctataatgttcataccagatattcctccttgtaaacgaatttgcggaacatttccatccatttcgtgaattcagccatcattacgtccatatccggctgctgacccagcatgcgggcttcatgcagatagccgtctgccatccagatcagcatcttgcagatctcatggggggatatgccatccttaaatttgctggcgtctatatggctgaaataagcctgatagatcacatcctgctggacgaagttatgattcctgagatcatccgaaacatcttctttctccgagtagaatgcccgcatggcaaaatccatgatataggggctgccttgctccattacctttactttttgacgggccgcatattccagaagttcaaagaaatcagtaatattaagaatgtccctgtcaggcaactgttctttcattacatccatgatatagttataaagatacagatacagttccttcttattatgaaaataatagaacagagagcctttggaaattcctgcttttgcggcaatcaggtcggtggaagcatgcttgtaatcgtactttgagaatacttctatggctgcattgatgatctgatggcgtttttcttccggaagggcaaagaatttttcgttcatataacctcctttatataactggctttggatgttcgccggtctgattgactggaatggtcagttcttaaatatcagaatacctgattgactggaatttacaacccctttatgagaaatttccgctattttttcaaagcggttttccaggactgatggaagagccagccgccaaagaccgtggctgcgatataggagaggattccggcctcattgccccataagcgtacgatatcacggaacacgatctggttcatataataatgagggctgatatagaacatattgatagcgccatactggtagaatgtcagattgaaaaaggtcgccaaaagacagcaggaaaggtagcagcatgcgctcccgagaaagcctttcgccgaatcatcggcttcttttgataaaccggcaaacaatccgattgtaatcagcaggatgtgccacgcataagagtggatggtcagtggcagatattcatagtgcatgccgcttgtatcaaagaacgcaaagattccgcccagcagtccgaagttcataaggaatgtgatcagaatgctgcgcagcctttcggtatgtatccaaggaatcaccaggcacagatacatagggatgctgcataactggaaggggaaataccaccagttatattgcccgtggttcaggatataagtaaggcaccattgcttccacaactcgcttaaaagcatcaggatgccacagtataggtaaaaacgattctgcttcttcatatcagataatctccttgcttttattatacacaaataaatgccattatgctataatacggatagttgtctgctgacaaaagaacaatagatattggagtgagcgttatgaaaataaaaaatggaattatgctggtgctgaccgcatttatatgggggacggccttcgtggcccaaagcgtcgggatggactatttgggaccttttacttttaatggcgtgcgaagcctgattggcggcgcggcgctgcttccctgtatctggctctttcagaaaggaaagggcaaagccacagagaaacccagccgtggcgcgaggaaggaactgatcgcagggggaatcgcctgcgggcttcttctgtttgcggccagcagcctgcagcagattggaattcagtatactacggcaggaaaagctggatttatcactgcattttacatcgtgatcgtaccggtgctggggatatttcttcataagaagatcagcgggaaggtctggggggctgtggccatagcgctggcgggactgtacttcctttgcattacggagaagtttgccgtgggaaagggggatatcctgattttcctatgtgcgcttgtattttccattcatatcctggtgattgactatttctcgccaaaggtggacggagtgaagatgtcctgcatccagttcttcgtctgcggcatcgtatccctgccgcccatgttctttacggagacgccgaagatcggggctatcgtggaagggtgggcgccgctcttatatgcgggcgtgctgtcctgcggcgtggcttacactttgcagatcattggccagaagaatgtgaacccggcggtcgcttcattaatcttaagcctcgagtcctgcttttccgtgctagccggatggatggtgctgggagaaaaactttccatgagggaatccgtaggatgcgtcctgatgtttggcgcgattattctggcacagctgccggataggaagaaggaggaactgcaatatgaataatcagctgatcatggagatgacgcgatattatagcggagatccaaaacatatccagcattttatgaaagtctatgcatatgccaggatgatcggcgagatggaagggcttgacagaaagacgcagcacatgcttgagacggcggcaatcgttcatgatatagggattaaggaaagcatgaaaaaatatggagacagcgctgggcatcatcaggagcaggaaggccctgcggtggcggaaaatatgttggagcgattgggctatgaaggggatattatcaaaagggtctgctatctggtaggccatcatcatacttatcagggcatagatggcctggactatcagattctggtggaggcggacttcctggtgaacctgtatgagaacggctcttccaaagatgaggtgctggcggctatggacggagtatttgttacagaaagtggaaaagatatcttaaggaatatgtttcttgcatgatatgaaaagatataaaaggagaaaatgacaatgatcagagaaatcagagaagaagataagcagctgtatatggatttgacggaagagttttataattccgaagccgtgcttcatccgattccggaagcataccgggaggcgaccttcgaggagatgatgcgctcacaagattatgtaaaggcctatattcttgaaaaagatgggcaggccgcaggctatggcctgaccagctatacattttcacaggaagccggcggcaaggcagtatggctggaagaattgtatatccgcccccagtttcgctgtcatggactgggaaaagagttctttgcctacgtggatgaacagattgcccctaaggtaatgcgcttgcggcttgagatcgagccggataacctaagggccaagaaactctatctggcaatggggtatgaggatcttccttatgcacagatgataaaagaagtacaggaggttaagtagatgcgttttgtaatacagagagtgtccgaaagcgaggttaaagtagacggacaggtaattggaaagattgggaaaggcttcatggtgctgatcggcgtatgcgattccgataccagggaaattgctgataagatggtcaagaaaatgctggggcttcggatattcgaagacgaggaaggaaagacgaacctatcacttgatacggtgggcggaagcctccttctgatctcgcagttcacgctgtatgcaaactgcaagaagggaaaccgtccaagcttcatcgaggccggagagccgaagatggcggaagagatgtatgagtacattatcgaaaaatgcaaagaacaggtagaagtggtggagagaggccagtttggcgctgatatgaaggtgagtttggtaaacgacgggccgttcacgattatactggattcggagaagctgtaggctaagtggacacgtaacacttttcaaaagtgttacgtgtccacttagctttttttgttaaaatatctaattaaatttctgtaaaaagttatagtgaattcttaaataaatataaatacgttgacatttatggtaatattgactaatataatcgttagatatctaactaattgttggattggacttttgagaggaggcgcatcatgcaggatacaaaggatgtatctgtctttatactgctgtttcagatacagcatctaagcagatatcatgccatgaaacggctggaggaactggaattaaagccagggcaggccggaatattatttacattaaatgtggaaggggtgctctcccagaggcagctggccgaaaagattgggattacgcctccgtccatgacggtcgcacttagaaaactggaagaacggggatacgttcggaaggagccggacggcagagaccagaggatcatcagaatccgtctgtcagagaaggggaaagaatgtgtagaagacctgaagaaggttatgggcgatatggaagagattatctatcagggaatgtcccgggaggagaggctgctgctgaagcgcctgcttctggaaatgcgaaagagtctgatggattcgaaagactttaaggggatggatatgtgctctatcatggagaagacccgtccgtccaagggacctaatgatttctagaaaagaaaggaaagacgctatatgagtaaattattgaagtttttgaagccatatgcgggcgcggtccttgcgatcctgtgcgtgctgatcgttcaggcgtactgcgacctgtcgctgcctacctacacctccgagattgtaaatgtaggcatacagcagggcggcattgatgagactgtgccggataccatatcggaggaagatttggatcacctgctgctatttgtgccgtcggataagcgagaggtggtagaatccgcgtataaagaagatgcgggcgcttatgattacgacggaaaagtcatgaagctgaaatcttccgtgaagaaagacgaggataagatggatgaactgtcctcccttctcggcaagcctatgcttcttgcttccggatttgattcagacagtgacatgacgaagaagatggaagagcagatgaagcagcagatgtcatcccagatggaagcgcagatggatgagcagatagacagccagctgaaggaacagcagctgccggatgctgcaaaagagcagatgaagcagcagatgaaagagcagatgcaaagtcagctgccggatgtaagcaagatgtccgtctacgacatgtttgagatgatggaagataagcagagagattctgcggtaggggagatcgaaaagcagatgaaatccatgccggattccatgattgaacaggctgcagccacatatatcaggaatgcgtatggcaagataggcctggataccgacaagatagagacggattatatcctgggcactggagctaagatgcttgccctggcggctcttggcatggtggcgagcattatcgtagggctgatggcgtcacgggtgggcgccagcgtaggaaagggcttgagaagagacgtattccgcaaggtggtgggattctccaatggagagtttgatgagttctccacagcctcgctgatcactaggagcaccaacgatatccagcagatccagcttctgaccgtcatgattctaagaatggtgctgtatgcgccaatcatggcaatcggaggaatctggaaggtatttaatacgaacgtggatatgtcctggattatcggcattgcggtaggccttatcgtgatggtcgtaatcgtgctgtttgtggtggtcatgccaaaattcaagattgtacagaaccaggtagaccggctgaatctggtaagccgggagatactgacaggacttccggttatccgtgcattcagtacggaaaaatatgaagagaagcgttttgacggagcaaaccgtgacctgacgaagacgaacctgtttgtaaacagggctatgacattcatgatgcctatgatgatgctgatcatgaactgcattgcagtgcttatcgtatggattggcggccatagcgtaaataacggcactatgcaggttggcgatatgatggcatttatccagtatacgatgcagattatcatgtccttcttaatgatctgcatgatctctgtcatgctgccacgggcagccgtatccgcaacccgtgtggatgaagtccttgtgagccatacactgatccacgaccccgagaatccgaagaaacttccggaggatggtcatggagaagtgacatttgatcatgtatccttccggtatccgggggcagaagaggatgtcctgcatgacatatcctttacggctaagccaggacagaccacggcctttattggaagtacgggaagcggcaagtccacgcttgtcaatctaatcccgagattctatgacgtgaccgaagggaagatcaccctcgacggcgaggatatccgcaatatcacgcagcatgaactgagggataagctgggatacgtgccgcagaagggcatcctgttctcgggagatattgcttcgaacatattatatggcaaccctgacggaagcgaggaggatatgaaagaagcggctacgattgcccaggctacggagtttatcgaggcgaagaaaaagaagtaccaaagttcgatatcccagggcggctcgaatgtgtccggcggacagaagcagcgcctgtctattgcaagagcgatcgcgaagcatccaaagatctatatctttgacgatagtttttccgcacttgattacaagacggatgtgacgctgagaaacgcgctgaaggaaaagacggccgacagcacagtcctgatcgtggcgcagagaatcagcacgattctgcacgcagaacagattatcgtactggatgaaggaaagatcgtaggaaaaggaacccatgaggaactgctgaagaattgcgatgagtattatcagattgcgtcttcccagttatcggagaaggaactggaagacaatgtaaaggaggtgggctaatatgccaagaagaggtccgggacatggtccgatgcctggagagaaggcaaaggactttaaaggcactatgaaaaaattgatgggctatatggggaaatataagattgccctgctctttgtggtcatatttgccatcggcagtaccattttcaatatcgtaggccctaagattcttggaaaggccacgacagaaatatttaccggcctggtaggcaagatatccgggggaagcggaattgatttcacaaagatcggaagaattctggcgacattgctctgcctgtacttatgcagcgccttgttctcgtttatccagggatacatcatgacgggcgtatcccagaagctgacctaccggatgagaagagagatctccgagaagatcagccggctgccaatgaactattttgataagatgacccacggagagatcctgtcacggatcaccaatgacgtggataccctgagcatgagcttgaaccagagcgcgacacaggtaatcacctcggtgacgacgatcatcggagtgctgatcatgatgctcagcatcagcccgctgatgacggtgatcgccctgttgatccttccgctgtctatggggctgatctctgtgatcgtcaagcgctcccagaagttcttcaaaagccagcagaggtacctgggccatgtcaatgggcaggtggaagaagtgtacggcggacatagcatcgtaaaggcattcaataaggaaaaagacgtgatcgcggcatttgaccgggacaatgagatcctctaccagtctgcatggaagtcacagttcctctcaggaatgatgatgcctatcatgcagtttgttggaaatcttggctatgtggctgtagtcatccttggtggctacctcgcgatcaagaagacgatagaagtaggcgatatccagtcatttatccaatacgtaagaagttttacccagccgatccagcaggtagcgcaggtggccaacatgcttcagtccacggcagcagcttccgagcgcgtgttcgagttcctggaagagccggaagaagaccagatggtgccggatgcagtggctttggaaggcctggaagggcgtgtggaatttgaccatgtgcatttcggatataatccggatcatatcattatcaatgattttagcgccaaggtagagcctgggcagaagattgccatcgttgggcctaccggagccggcaagaccaccatggtcaagctgctgatgcggttctatgacgtcaacagcggcgccatcaaggtagacggccatgatatccgtgactttaaccgcagcgagctgcgccagatgttcggcatggtactgcaggatacctggctgtttaaggggagcattgaagacaatatccgctatggcaagctggacgctacccatgaagaggtggtcgaggctgccaaggctgcccatgtacaccgttttgtacagacgctgccgggaggctatcgaatggaactgaacgaagaggcgagcaatgtgtcccagggacagaagcagcttctgactattgccagggcaattctggcggatccgaagattctgatccttgatgaggcaaccagttccgtagatacccgtacggaagtcaggattcagaaggcgatggataatctgatgcgtggcaggaccagcttcattattgcacaccgcctctcaaccatccgcgacgcagacctgatccttgtcatgaaagacggagatatcgtcgagcagggtacccatgaagaactgctggcaagaaacggcttctatgcggatctttataactctcagtttgaaagaagcgcataggagggcaaaactatggagcgtatagatcagcagtttgaattcttaagagagattgacaaagagaagtttattggccgccagacttatctgacggatggaaaacgaaaggaaaacgatgcggagcatgcatggcatatggccattatgaccattcttcttggcgaatatgccaatgaagagattgacgtcctaaagacggtgaccatgctgctgattcatgacattgtggagattgacgcgggcgatacctatgcctacgacgaagagggcaaaaagacccagcgggagcgggaagagaaggcggcagagaggatattcggcctcctgccaaaagaccagtgcaggaagatgagaagcctgtgggaagaattcgaagcctgcgagaccaaggaggctaagtttgcccgaactatggataaccttcagccggtcatgctcaatgatgccacggacggaaaagcgtgggaagagcatggcgtttggcttcagcagatactgaaccgtaaccgaaatactgcggatggctcccaaaccctgtgggagtactccctgaaccactttatcaggccgaatgtagaaaaaggccgtataaaagacagcgaaaaaggaaaggacagcatctgatctgcaatgaaaacagccgcccggattcgggcggctgcgcttgtgtaagggctgctagtaaaatatgcggtccattacttcatggaaagtccagtcaatacggattttacgtggtcgacttcctgctgtgtcgcttttgcggcagggacataatagctcttttctctggcaacctggtaaagtttttcctgagacatttcgcattcgttgcgaagctgctttaagcaggcttttaattccttgttttctgtctgtgagatcatttcgccgtagcgtacaagttctccattgacgcctgctaaggcgtcagataccattgttttgtcatccaacatctcgcttacctcctataagaatttcatcaagtcttgcttattcttcattgcagattgtgcagcatcctggaagagtttctgcacttccggatcctgtgcctgtgaggcatagtcctgcatcttgcagtgacttgtgtcaaagccgccgatcaagtggcgtaagttctgtaagtcgagtatagatatatcagccatattcgtttcctccttttaccctttggattcaagattattttgtccctaagtcggagaaaatatactgtagattcttagcatctgcggctttttttaaaaaagcatggaacaacttctgcataggctctatggactggtacatgcattccggatgccattgtacgccgaggacgaaaggacggcttacagattctaccgcctcgatgacgccgtcagaagcgatggcagtaatcttaaggtccgttcccagcgtatggacggattggtgatggaaactattaacgtacgcggagtctcctagaatattatatagcatgctattttgtgagaccgtgattttatggctcgtgtccgcgcggctctcagataactgcatatggtttagggaggatgccggacgtaaggcaagatcctggaagatggtgccgccgagggcaatattaagaatctgcatgccccggcagatgcctaggattggaagcttggtctggagggcatattccatgaaggaaaggtgggagatatccgtacgggtatccgtccgtccacgatctgtctgtagttcttcgccgaacagaagcggacttacatcatcgcctccgcagaacaagaagccgtcgcagatcttcccatagtaagggaatgcttcttcttccctggtacagggaaggattacagggatgcctccggcatcttccatggctctgatgtaagtctgcggcacgaattggcgctgatccatgtatccgcacgctacgattccgatgatagggttcataatatgactcatcctttcaaaataatgttcactttataggcaaacggagtatacttataattgacaaatgttattatgaaagtatgaaaagaggctggtaattatgaaactaatcgatatgcactgcgatactttatggaaattgatggatctggataagaaggggaacctgatggagaatgcctgcagcatcagcatcccttccatgaaaaaggcgcgatccaaggctcagttttttgcatgctttacttatataaaagattatgagtccaacggagggtacgataaggcatatgaacatgtatttgagatgatcgcctatatgaattctcaactggcagcgtatgaaagggagatatccctggcccgctcttatacagagttggagaaaaacgccgcagaaggaaggatatccgcattcctgacggtggaagaaggcggaatcctgaatgggcagatgaagcggctggaagatctctatggaagcggcataaggctgatgacgattatgtggaattacgaaaactgcatcggacatcccgccagcaaggacgcttccgtgatgtggcaggggctgaagcccttcgggatagaggtggtccgccggatgaatgaattgggaatgatcatagatctttcccacgcatcggacggcacgttccgcgatgtgctggaatacgcggcaaagggcccggtggtagcgtcccactccaattgccgggcgatcgcggaccatcccaggaacctgtcggatgagatgatacggaaactggcaaatgcaggaggtgttgcaggcctgaacttttatggcccgtttcttggaaacgatgaagagtcaagaattgaccagatggtggctcacatccttcatatgatccgaacgggaggaagcgagtttcctgctattggaacggattttgacggttttgacggaatgaaggttatggaggttccggatatatcgcagatggaaaaactgtgggatgcgctgaagaaggccggcgttggggaacgtcagctggataaattatggggaggaaatgtggagcggattttaaattacatatagagcatgacaaaggcgggccgctcggtttacgaacggcccgccttttgtatattgggattctatttgggattatttctggctcttttcaacttcctgcatcttcagcgcgcggacctttagcggcagtccgaacagattgatgaatccttccgcatcatgatggtcgtacaattctccggtggtaaagcttgccagagactcgctgtataaggaatatggagatgtggttccggccttgatgatatttcctttgtaaagtttgaactttacttcaccggtcacgtattcctgagtgctttcgatgaatgcctgaacggcctcgcgaagaggcgtgaaccattttccttcatatacgatctgactaagcttgttgcccatttcttcttttacttcataggtggcgcggtctaacaccagctcctccagctgctggtgggcctcatagagaatcgttccgccaggcgtctcatatacgccgcgggacttcatgccaaccacgcggttctctacgatatcgcagattccaatgccgtgctttccgccaagctcgtttaacttgcggatgatatcggataccttcatctcttccccattgatactcttaggaactcccttttcaaaggtcatggtgacatactcgccctcatcaggcgctttctcaggcgttacgcccaatacaaggagatggttgtaatttggctcgtttgccgggtcttccagttccaggccttcatggctgatgtgccataagttacggtcacggctgtagctgtggcttgcgtcgaacggaaggtcaattccgtgctgcttgcagtacgcaatctcctcttcacgggaattcatggtccaaacgtccgtcattctccatggagcgatgatcttaagatcaggggcaagagccttgatgccaagctcgaaacgaatctggtcatttccttttcctgtagccccatggcagatggcgctggcgccttcttttcttgcgatctcaaccagtttcttggcgatcgcgggacgcgccatggaagtacccaggagatacttgttctcgtatacagcgtgtgcctgtacgcaaggaacaacatagttgtcgcagaaatcatcgacaatatcttctatgtataatttggatgcgccggaaagtttagcccgctcttccagcccgtctaattcttcgccctgtccgcagtctacgcagcagcagatgacttcgtaatcaaaattttccttcagccatggaataatggccgtggtatccagtccgcctgaatatgctaatacaactttctctttcatgtgaaaatcctcctaatatagaatctttatttgacttttttaaaattcataactgcatcattgtcaatcgcaaaacatactatacactattttttataaatatgcaagaataaaatgaaaaaaagtaaaaaatatacaaaatatgcatatggtttgaatataaagtgaaaaatatgcagcctttatgaataaatctccagaagaaatgtaaaggcatcgcttgacatatatcgactatctatatattatatagatagtcgatatatagggagtcgatataaatttggaaaggagaaacgttatggcgattgatagaagtctggtgtccggaagcacgtcaatgctgatattgaaactgctggaaggaaaggatatgtacggctatgaaatgattgaagccttgcgcgagaaatcgaacaacgtatttgaattgaaggcagggaccttgtacccgcttctgcatgggatggaagaaaaaggatatcttggatcttacgagcaggaggagggagggaagatacgaaagtattatagtattacgaaagaaggaaagaagatcctgaagcagaaaaaagaagactggatggcatattccaaggctgtcgtggacgtattaagcgtacaaggagggatggcatgaagacggaagaatacctgaaaaaactgacggatcagatccggtgcgcgaaagccagggcggcgattgcagaagagatgcgcggacatatcgacgagcagaagcatgcctatatgagcgttgggatggaagcggaggaagcggaagaagccgctgtgaaagagatgggggatccggtggaggcggggagcctgctggacggcatccaccggcccaggatggcctggggaatgattggcttgatcgccgtccttagcatagcaggtttcataatcctatatctgctgcaaagaaattttagcgatatgacctttgtgacaggaagccctgtgcattttgggggctgggcaattgctggctttgcgggaatgataggggcgtgctatttagattacagcaggatcggacgctgggcaaaggagattatgctggcggcctctgtggttctgcttgtgggcatagaacattacggaacatccataaatggcgcgattggctggatttatggatatcaggtgaatgtgaagctgctgcttttccttttcgttcccttgtatggggctgtgttataccaataccgcggagaggggaaacgagcagtcgtaaaaggcattctttggatggccccggcgattatgaccgcgcttaagatcccaagtacggctacggtgcttatcctgtttctggcattcatggcagtgctgtctattgcaatctataagaactggttctgcgtgtcccgcaaggcagcgcttgggcttctgtggctatctgccttcttgcccgcgatactgttctgcctgcatatatttacaagtggcccgccctatcagcgtgccaggctatgggacatggtgcatgcgggggcgacagtggagaaaaataccataggacagatcctgtctgatagccagctgattggcagcccaaatgggggacttggcaaggtggcgcggcttccgggcggaagcgactatgtgcttggctatattgcggcctgctatgggattcttatcgcagtggcctttgccacattgatgacggtcttgttcctgtatttcctgaaactttcgttaaaacagaagaatcagctaggaatgatcatgggatgcggatgttctttggtactgttcttccagctgctggtctatatccttatcaatataggcataatgccgataggaagcgtctactgtccattcattacctatggaagattcgggatgctggtgacctatgttcttctgggacttcttctgagtatctacagataccaggacgtgcctcttgaaatggagaagtccgtccggaaacgaagaaagagaaagcctgtatcaaattaaaaatcggtcgaattctaaaaaattacttgacaaagagaaaaacatgagtaaaattattagaaaatgagatactaatgaacgactatacacaaaaaaggagtagttattatgaaaggttcgcgcatcatgaatcatgacagcatcataaataacgcatgctctactctgccttctatggacagtgttgtttttgtgccgtgccgccccaatccccttggggtgtatttggcataaaattcaatattgtttttggaagataggatatcgttgtacttgtcgctttatattctgcataaaagaaataaagggaaacagaagtgtggcatatgcttctgtttctttttttgctcttttataccgatcaagcagcaaaagcggcagacacttatataagcagaggagagaaaaatcatggactacaggcaggaattgaaagataagaaaaagattgtgatcaagataggcacatcgaccattacctatccggagacaggaaatatcaacctggacaagctggaaaaattcgtaaggatactgatcaacctcagaaataagggaaaagaagtcatcgtggtgtcgtcgggtgccgtgggcattggaagaaatgtactgggcttttctgaacggccaaaggagaaggcgatccgccaggcctgcgcggcggtaggacaaggaaggctcatgatgatgtatgaaaaactctttgcagagtacagccagctgacggcacaggtacttttgacgaaagagtctattaccaatgaagagtgcaagaaaaatgcgaggaatacgtttgatgaactggccgcaatgagcgtggtgcctatcgtaaatgagaatgacgcgatatccgtagacgaggaattgtacggaaactttggggacaacgatacaatggctgcgtatgtggcgtctctggtagatgcggatcttttgatcctgatgtcggatatcgaggggctgtatacagatgatccaaagaagaatccaagcgcacgatttatccatacggtagggcagatagacggggaactggaaaagatggggaagggatctggaaccggacttggaaccggaggaatggcaactaagatagaagccgcaaagatcgcgacacgctccggagcggatatggtgattgccaatggagataatatctatacgatcaatgacgtgatggcaggaaagaaagtagggacgctgttcctgtcaaaggacagaggcgatctggcaggaaatgagatggcgccggtgcgggagcaataccgcagacaggcgaaaaggcgtaaaaaggaaggcataaataaagaactggcagggaatgttattggcagccagatcagtacaggaggacaggcatatggattacatgcaggaaattggtaggacggcaaaagaagcttcatccaaggttcagttcttaaagcagacgcagaaaaatgaagggctgtgttctgtggcaagagaactgcggatgcagacgccttttctgcttcgggaaaatgcgaaagacgtggcaagagtcaaagaagaaggaatgaagccggctatgatcgaccggctgctgcttacggatcagaggatccatgccatggcggacgggctggagcagatagcgaagttaaaagacccgatcggagagactgtctctatggaagtaaggcccaatggcctgcagattggcaaaagaagggtgcctcttggggtagtggggatcatctatgaatccaggccgaatgtgacggcagatgcctttggactttgctttaagacagggaatgtggccatcttaagaggaggttcggatgcaatccgatcgaataaggcgatcataaaagtgattagggatgggcttaagaaggagcagctgccccaggatgcggtgcttctggtggagaatacggacagagatgtggccacccagatgatgcggatgaatgaatatatcgatgtgctcattccgcggggaggcaaggggctgatcgcaaacgtggtggaaaacagcacggtacccgtgattgagacaggaacaggcaactgccatatctacgtggacgcatcggcggatcttgacatggcggtatcaatcattgacaatgcgaagacgcagcggatgggcgtgtgcaatgcctgcgagtctctggtggtccatgaagagatcgcgcctgtggcaatacctgcaatctacgaaaggctgaggcagaagcaggtggaggtgcgcgcagatgacagggcctgccagattcaggaaggaatgacccgggcaggggaagaagactggggaatggaatatctggacgcggtcatatcccttaaggtcgtctccgggattgaggaagctatttcccatatcaatcggtataataccggccactcagagtctattattaccagggactacgccagcgcgctgaagtttctggatgagattgatgcggcagccgtatatgtcaacgcatccacgcggtttacagacgggcatgagtttggcttcggggctgagattggaatcagcacccagaaacttcacgccagagggcccatggggctggaggcgcttacaacgacaaaatatattatcttcggcaatggacagatacgtccttaagcagcatattggaaaacccccaaaaaagtacttgcatattatgcatattagatgtataattatgcaagtactttaatttggacctgtatctggacatttgtaaaaaagtggtataatatttacaggtgcatggttataaatacattcaggaggatataaaatagatgattaaagtaggaattataggcgctacaggctatgcgggcggcgaactggcaaggatattgatggggcacaaggatgcagaaatcgtatggtatggctccagaagctacatagataagaagtacgcggatgtataccagaacatgttccagatcgtggacgccaaatgtctggatgacaatatggaggaactggcaaagaaggcagatgtcatctttaccgccacgccccagggattctgtgcttccgtgatcagcgaagccatcctggctgatacgaagatcgtggacttaagcgctgactttcgcattaaggatgtggcgacttatgagaagtggtatggaatccagcataaaagcccgcaatttatagaagaagccgtgtatggactgtgcgagatcaaccgggaggatgtcaaaggcgcaaggctggttgccaacccgggctgctatacgacttgctcgatcctcaccgcctatccgctggcaaaagaagggctgatcgatatgaataccttgatcattgacgcaaagtccgggacctccggcgcgggaagaggcgccaaggtaggaaatctctactgcgaggtaaacgagaacatcaaggcctatggagtggcaagccacaggcatacgccggagattgaggagcagctggggtatgcggcgaaggaagatgtgcggatcagttttacgccgcatctggttcccatgaaccggggcattctggcaaccgagtatgcaacgcttacgaagcaggcgacctatgaagatataaaggcagtctatgataaatactataaggaagagaagttcatacgcgtgctggaggaaggcgtatgtccggagacaaagtgggtggaaggaagcaactacgtggacattaactttaagatagatcccaggacgaaccgtatcatcatgatgggagccattgataatctggtaaaaggagcggccggccaggcggtacagaatatgaacctgatgtttggccttccggaaagcgaaggactggaacttgttccaatgttcccatagaggtggcttatgatacggacaatgacgattgaagattacgatgaagtatatgccctgtggaccaagatccgcgggttcgggctaagaagcgtagatgactccagagaagggatcgcgcgcttccttaagaggaatccaacaaccagcgttgtagcggtagaagatggaaaggtagttggaagcattctctgcgggcacgacggacgaaggggctgcctgtaccatgtctgcgtggatgaagattaccgaagacggggaattgggaaatccatggtggtaaaggctatggaagagttgaaaatagaacagatcaataaggtatgcctcatagcgtttacaaaaaatgatgtaggaaacgcattctggaacacgattgggtggacggagaggctggatctgaattattatgattttgtactgaatgaaaagaatattacggcatttaatgaacaataacaggccgcatataaggaggaagaattatggagatcataaaaggcggggttaccgcggcaaagggatttgaagcagcaagcacggcagcaggaatcaagtataaggaccggacggatatggcgctgatctacagccaggcgccttgcgtggccgccggcacatttacgaagaatgtcgtaaaggctgcgccggtcaaatgggatcagcaggtagtcggaagcggcgccaaggttcaggcggtcgtggttaactctggaattgccaatgcatgcacaggagcagaagggtttggctattgcaaggacactgccgtggctgcggccaaggctctggatatctctgaagatggcgtgctcataggctctaccggagtcattggaaaacagatgccgatcgataagctgactgcgggcatcgatgtactggctgaaaagaagaatgatacgctggagaatggcacagaggcagccaaggcgatcatgacaacggatacctgcgagaaagagctggcagctgtcatagaagtgggaggcaagaaggtgaccatcggcggcatggccaaaggttccggcatgattcaccccaacatgtgcaccatgctggcgtttattaccacggatgccgtgattgccaaggagacccttcagaaggcgctgagcggggacgtggatgatacctacaacatgatatccgtagatggggatacttccaccaatgatacggtgattctgctggctaatggtctggcaggcaatccggagattgcgtatggaagcccggagtacgaggaattcgcgcttgcccttcataccatcaacgagtatctggccaagaagatcgctggggacggcgaaggagccacggctctgttcgaagtaaaggccataggatgcgagagcgtggagcaggccaagactcttgcaaaatccatcgtatgttccaatcttaccaagacggcaatcgccggtcacgacgctaactggggcagaatcctctgtgcgatgggatattccggcgcgcagtttgatccggagaaggtagacctgttctttgagagcaaggcaggaaagatccagatcatcgaaaatggaacggcagtggactacagcgaggcagaagccacgaagattctctccgagcctgaggtcaccgctatcgcggatgtgaagatgggagcggaggaagcagccgcatggggatgcgacctgacccatggctatatcgagatcaatgcagactacagaagctgatgcgaaaaagagggggcgaaggaatcatgaaccaatcaatgcagaaatatctggataaggcggaggtgctgatcgaagccctgccctatatccaaagattcaaccggaagattattgtcgtgaagtatggcggaagcgccatgatcgatgaggaactcaaagaacatgtcatccaggatgtgactctgctgaaactggtaggcttcaagccgatcatcgtacacggcggcggcaaggagatcagcaagtgggttggcaaggtaggcatggagccggagttcgtcaacggactgcgggtgacggatgaagcgacgatggaactggccgagatggttctcgggaaagtaaataaaagcctggtacagctggtggaaagcctgggcgtgcgcgcgatcggaatcagtggaaaagacggcggattgctaaaagttgaaaagaaactggcagacggcgaggacatcggattcgtgggggacgtcaaagaggtgaatgcagatatcctttatgaccttttggagaaggatttccttccgattgtatgcccggtgggactggacgatgaatttaatacatataatatcaatgcggatgatgccgcgtgtgccatcgctagagcggtaaaggcggagaaactagcattccttacggatatcgagggcgtatataaggatccgaaggatccggataccctaatctcggaactgcgggtatcagccggcaaacagctgatggaggaaggctatattggaggcggaatgctcccgaaacttcagaactgcattgacgccatcgagaacggcgtttccagggtgcatattctggatggaagaattcctcactgcctgcttcttgagatattcaccaacaaaggaatcgggacggcaattttaaatgatactgaggaaaaatattatcatggagaatagaaatgaataaatatatagaagagacaaacagtggacttgtgcacacttataatcgctttccgctggtgctggaccggggggaaggagtctatctttacgatgaaaaaggcgacaaatatctggactttgcaggaggcatagctgtatccggcctgggatatggctgccaggaattaaatgatgccctgaaaagccagatagacaagatgattcacagttccaacctatactataatacgacctgcggacatgcggcagaagaactgaagcgtatcagcgggatggacagggtattctttaccaacagcggaacagaggctatagaaggcgcgctgaaggcagccaggaaatacgcgtataaaaagcagaccgggcggtatgaattcattgcaatggagaattcatttcatggcaggagcatgggcgcattgtcggtgacgggaagcgatgcttaccgggaacccttcgagccattggttccgggcgtgtcgtttgcagaattcaataaccttgacagcgtcaaggctctggtgaccagtcagacttgcgcgattatcttagagcctctccagggagaaggtggaattaatgttgccacagaagaattcatggccggaatccgaaaactttgcgacgatgaaggcatactgatgatctgcgacgagattcagtgcggcatgggacggaccggcgctatgtttgcctaccagtcttatggaactaagccggatattatcgctatggccaaggctatcggaagcggcatgccggtaggggcatttgccatgacggaagcggtggcggagttttctctggagcctggggatcatggaacgacctatgggggaaatccgctggcctgcatggcagtaagcaagacgatagaaatctttgagaagaaaaatatgatctcccatgtgcaggaaattggcgcctatctggcagaacagctggagaggctggtgcaggaaaaagactgcgtgatcgcgagaaaaggaaaaggcctgattcagggaatcgagatatcaaagcccgtaggagaagtaacaaacgccgcgcttaaggaagggcttctggttatcagcgccaggggaaacgtgatccgtctggttccgcctcttgtgatagagaagcagcatgtggatgaaatgatcgataaattgtcaaaagtgctatagacataaaaaaacaatcattggatatactatctacaggaatgtaggaggtatatctgatgattggtttttttattgcgcttttatccggggcgctgatgagcgtccagggagtatttaatacacaggttacaaagacgacaggcatgtgggtgagcaatgcatgggtgcagttaagcgcatttgcgctgtgcctggtggcatggctgatcgcggggagggacagtgttactaccctggcaaaagtagagccgaaatacgtccttttaggaggcgtcattggggcaggcattacctggaccgtaatcaaaagcatggagcagctgggacctgccaaagcggcgcttctcatcgtcatttcacagttgatcgtcgcctacgtgatagagcttcttggcttgttcggcgtggataaggagcctttggaatggcgtaagataatcggcatggtgattgcgctgattggagttgcaattttccaatggaaatagtacaataattttatctaggcataatcggggtatttgcagtttcgacagactgtaaaggagttttttatgcatagaaatagaataaaaatgatatgttttactatcggttttacaatgacggccctcctggccggatgttccgggaaacaggacgccaggactgtggaactgtcggaggcaaaagaaggcagcgttgccgaagaaaaagaagaagagacagaagaaagcgccattgaggaaaacgaagagatctatgtacatgtatgcgggaaggtaaatcagccgggcgtatactgccttccggcaggcagcaggctgtatgaggcaattgaggcggctggagggcttaaggaaggtgcggcggcagaatctctgaaccaggcacaggaggcccaggacggacagcagatctacgttccttccatagaagaggcgtccgggggagaagcatcagaagcgggagtaccggctgaggcatccgatggaaagatgaatcttaatacggcagccaaagagcagctgatgaccttgactggaatcggagaggccaaagcagcggcgatcatccgctaccgggaagagaacggaggctttcggagcatagaagaattaatggaagtagaaggaatcaaggaaggcgtatttaacaaaatcaaagaccagatcaagatttaataagggagataagtaatgagtagacgtgtattggttgtggatgatgaaaaactaatcgtgaaaggcatccgtttcagcctggagcaggatggaatggaggttgactgcgcttatgatggggaagaggcgctgaaactggcgaaagagaatgcatatgatatgattcttctggatattatgctgccaaagcatgatggctttgaagtgtgccagcagatccgggaattttccgatgttccgatagtaatgctgactgccaggggagatgacatggataagatactgggcctggagtacggggcggacgattacataacaaagccgtttaacatcctggaagtcaaggcgcgcatcaaggcgatcatgcgccgtaccagtaagagagataaagcccagcccaatgacaagattattatcaagggcgatatgaagatagactgcgaaagcagaagggtattcattggagagaaggaaattaatctgacggccaaggagttcgacttgctggaactgctggctatgaatccgaataaggtatacagccgggagaatctgctgaatatcgtatggggctatgagtatccgggagatgcaagaacagtggacgtacatatccggaggctgcgggagaagatagagacgaatccaagcgatccgaagtacgtttatacaaaatggggagttggttattatttcaggggttaggaagtattttaaacacaggatattcaagagtctccgctttcggattatccttctggttatgctggcagggattattcccgggataatcatgaaggcggtgattctgaacagttatgagaagagggcagtcgatgtacggactgcagagatacagaatcaatgtacaattctatgtaaccagctgagtaactccagttacttggacggtattacatccgaagtgatcaaaagcgagctggttcaactgtccaatatatacaatggacgagtcatggtcatcgcaaatgatttccgaattgctgaagatacatacgatatggataagggaaagaccatcgtgtcggaagatgtcatccggtgcttccagggaaagggcaccagtaattatgatgcaaaaaataagtatattgaggtgacatcgccaatcctggatggaaatacggaggcggtcaccggagtcatgctggtcagcgtttctacggataccatcgtggacagccttgccgtcctggatggaaaggcaagcattgttggcattaccataggagtggtaatcctggtgctggcatctcttgcggggtttgtgatggtgaagcccttccagcgcatcacgcgttccatatcagccgtgacggaaggatacgatgacaattatctccatgaaaatgcctatactgagacacagctgatctcagacgcattcaataagatgctgggtaggatgagggttctggatgattccaggaatgaattcgtctccaatgtgtcccatgaactgaagacgcctcttacttccatgaaggtacttgcagattcccttctgacgcaggaagatgttccggctgaattgtataaggaattcatgggagacttatccgaagagatcgagagggagaataagatcatcaatgacctgctgtctctggttaagatggacaagacggcaaatacgctgaatattaagtcggagaatatgaacaccctggtagaaaagattctgaagcggctgcgtccaatcgcggcaacccggaatattgaagtggtatttgaaagtttcaggccggtaactgcggaagtagatgagatgaagctgtctcttgcgatttcgaatctggtggaaaatgccatcaagtacaataaagatgatggctggatccacgtatctttgaatgcggaccataagtattgctacatcgaggtggcggattccggtattggaattccggaagaatcggcagagcatatcttcgagagattttaccgcgtggacaagtctcattccagggagattggcggaaccggacttggcctggccattgcaagaagcgcggttttgatgcacagaggagcgatcaaggtgtacagccagctgggcgagggaactacatttaccatacgtatcccattgacatatgtatcatagttcggaggtaagaggtatgaaaaataaattttggtccagcctgtgcattgcgctgtgcgtccttcttcttgccgggtgcggaaagggaaaggagccggatggatccggcacatatctgtactatgtgaaccagaagggcaccgggctggttaaggaatcctataagatcaaaggcgattctgtggaggatgagattaaagatgtgctgaaaacaatgaagaaagagccagactccattgattataaaagcgtgttccccaaagaggtacgcatcaagacctggacactgaatgataccaagctggatcttcattttaatgggagttataaggatatgccgctggcatccgaggtgctgcttcgggcggcggtggtccagacgctggtccagattgccggcgtggactatatagacttcttcatagaggatgagccgcttacggacaggaacggaaacctgatcggatacatgcgtgccgaagattttatacagaatacgggctcttctttgcattcttatcaacagggggaactgcgcctttattttgccaatgacaagggcgataaactggtgagggaggatgtaagcgtccggtataacagtaatatctccatcgagaaactgatcgtggagcagctgataaagggaccttcatcagataagggaaagccggtgatcccgccggagacgaaagtcctgggggtatcgttaaaagacagcatctgctatgtgaacctggatgaagggtttctcaacaatgcctatgtgctaaatcccaggcttacggtgtattccatcgtcaattcggtgatagacggaggcaattccagcagggtacagatatccatcaatggagaatccgatatcaagtatatggacagcattgatctgagcaagcctttgtccagagacctggatattgtggaggagagtgaaaaatgaaaaacaggccgctgttatgtacatgcctgatactgctggcgggggtcgtcttaagcgttttcgcgggaggcagcgcgctgatccgccagctgcggccctccccgctggaaatacgcgcgaagcagggagaggtgcttgccattaccggccaggcatataagatcgagaaaagagagaagcatcaggcagtctatctaaagaataattctattttacaaattcaaaaagatcagaaacaatcgtttcaagaatccaagtttattctatatacagatcccgaaatacagatacatatcggcaatgccataagggctgcaggagaattgtcctttttccaaaatgcccgcaatccggggaattttgaccagaaactctattatcagagacaggacatccatgggtcggcctgggccaaagaggtagaagtcgtggacgactccatatggaagatcagggactggctgtccgaattccgcagccagtggaagaaggcactgatccaggcaatgggggagaaggatggcaatgtcctaagcgcaatgctgctgggagaaaagtccgagatggatccggacacgaaggaactgtatcaggtgagcggaatcgggcatatcctggccatctccgggcttcacctgtcctttatcggtatcggggcgtaccgaatctttagaaggatgacaggctcctatacggcaggaggcatcgcaggcatcctgcttctggtcctatacgtcatgatgatcggggttacgatatccgctgtccgtgctttggtcatgttcttattccgggtgggcgcggatatggcgggacggcattatgacccgcctacggcacttgcggcagcagcggcggctgtccttttatggaggccgcttagcctgtatgacggaggcttctggctgtcctttggagcggtatttgccatgatcatcgtcctccccatcttcaaggggctgccagtgcaaggcttctgggcaagcgtgagcatcaaccttacgatacttcctgtcatgttattctatttctttgaatttccaccctactccctacttctgaacctgttcgtaattcccttgatgtctgccatgctgtttttgggcttgctgggaagcgctgcgtatgcggcaggcattcccatagccgtctttgggcttcgaatctgcaaggtaattctctggctttatgagaaatgctgtgagattggcatgggcatacccggggcgcgtatgattgcaggaaagccccgactgtggcagatcgcggcttactatatcctgctggcggcagccctggtattccttaggcggctgcgccggaaagaaataaagaaagcctccgggatggaaactacgggcaggataagaatcatgccattgcttgcccttgccgccggaattttcatactgacatttcggttcggagaagaaggaagactgtcggtgacgatattggatgtagggcagggagacgggatattcatccaaggcccagctggcggcacctatctgattgacggaggaagcagcgatataaagaaggtagggcaataccggatagagccattcctcaaatcccgcggagtggggaggttggactatgtcctgatatcccacggcgacagtgaccatatgaacggcgtggcagaccttattgagcgcagaaagatcggcatagagatcggcaccctggtactgccgatgcaggaggcgtgggatgaggccctttgcagccttgccgatatggcgcgccaggcagggatacaagtggcggagatcgggccgggacaaggcatccaggagaaggaggcggccttatcctgcatccagccggcaaaaggggatgagatccagccaggcaatgaagcgtccatggtcctggccctttcaagcggggagtttgatatgctgcttagcggggacgtggaagggaagggggaagaactgctgacagaacgcctgacaaaaacggagcaggcccggacttgggaggtgctgaaagtggcgcaccatgggtccagaaattctacgagcgaacgcttccttcagagtgttcagccggcatttgccatcatatccgcaggggagcagaaccgctatggacatcctcatcaggagacgcttgttcgtcttaaagaaaggggaataaagatctattctacccaggacaaaggcgcggttatgatagaggtcaaggatggaaaaatgaccatctactgaaaattggaaaatctggggtagaaaaaatagttttcttataccagactggtagttgaatttgagggaaaaaaacagtatacttctaagaagagatgaaaacagacagataggaaaagagggaattaaaaatgacttatgaagaagtattaagcaatgccaaaacttgtatgggagaattctgcaaggcctgtccggtatgcaatggcaaggcgtgcagcaacaaagtgccgggaccgggtgcaaaaggaagcgggacggtggcaatccgcaactatgacaagtggcaggaactgtgtattaatatggatactatctgcgagaataaaccggtggatctgacctctgagatttttggcagaacattcaagtatccaatctttgcggcaccgattggcgccatgaagcttcattatggagacaagtatgatgatctggaatataatgatatcctggtgtcttcctgcgcggacgcggggattgccgcatttaccggagacggaaccaatccggcggtaatggaaggcgcgaccagggcgatcaagcagaaggacggaaacggcattccgaccgtaaaaccatgggatatcaatacgctgaaagaaaaacttgcgatgatcaaggatgcaggatcttttgcagtggctatggatattgacgcggcagggcttccattcctcaagaatctgacccctccggcaggaagcaagacagtggaagaacttcgcgagatcgtgaaggaggcagaagtgccatttatcatcaagggcatcatgacggtaaagggcgcgctgaaggcaaaagaagccggagcggcagccatcgtcgtatccaatcatggcgggcgcgtgcttgaccagtgcccggctacggcagaggtgctggcagagatcgccgatgcagtgggaaatgatatgaagattctggtggacggcggcatccgttccggcgtggatatctttaaggcattggcgcttggcgcggatgcggtgctcattggacgtccgttcgtaaccgcggtatatggcggaggcgctgaaggggttgctgcctatacggcaaaactggcggcagaactggaagacactatggcaatgtgcggcgcgcatagcctttctgagatatccagagatatggtaaggtaatgaaaagtttaaacgaagatattaagacaggacaattcaagcaggcctacctcctctatggggaggaggcctatttaaaaaagcagtataaggataagcttacaaaagccatgcttccggaaggcgacaccgtgaactatgcttactatgaagggaaaggcacgaacccggcggaactgattgatctggctgagacaatgccgttttttgcggatcgcaggctgatcgtggtggagaattctggcttctttaagaatgcgactccggaacttgcggattatattaagaatatgccagagacggcatgttttctttttgtggaaagcgaagtagacaagcggggcaagatgtacaagtccgtcaaggacaagggacgggccgtggagatgggacgtcaggacgaaaagacgcttctgtactggctggccgggatggttaagaaggaaggaaagcagatcaaagagtccacagcccggtatctggtggccaagaccgggacggatatggagaatctggaaaaagagatggaaaaactcttctcctatacgctgggacagacggagattactgtccaggatgtagatgagatctgcaccacgcagattaccaataagatcttcgatatggtggaagcagtagccacaaaacagcagaagcgggcgcttcattattattatgacctgctggcgctgaaagagcctcctatgcggattctgtacctgctctcccgccaattcaaactgctgatggaagtgaaggatctgtcggggcgcggctatgagaagtcgcagatcgcgaagacggcaggacttcacccgtttgttgcaggcaagtatataaagcagtgccacagcttctccaaagaagaactaagaagcattatggaagatgcagcgaatatggaagaaatggtgaagaccgggcggctgaacgacaggatgagcgtggaacttttcattgtaaaatatagttccccgtgatatactggacgcatggcagcgggcaggacaggcaggtgccttcataagtatgtccgctggaactttgagaaatatacagctaaggggaaggatataagtggcaggaatagatcaaagcagaattcgtaatttttgtattatcgcgcatatcgatcatggaaaatctacgctggcagacagaatcatagagaagacaggccttcttaccagcagggagatgcagtcccaggtactggataacatggaattggaacgagagcggggcattaccatcaaggcccaggccgttcgtaccgtttatcaggccaaggatggggaggagtatatcttcaatcttattgatacgccgggacatgtagactttaactatgaagtatcgagaagcctggcagcctgcgacggtgccattctcgtggtggacgcggcccagggggtggaggctcagacccttgccaacgtctatctggcgctggaccacgatctggatgtgatgccggtgatcaacaaggtagatctgccaagcgcagaaccagagcgcgttatcgaagagatcgaagacgtgatcggcattgaggcggcggatgcgccgcagatatcggcaaagacaggactgaatatagaccaggtgctggagcagatcgtggaaaagatccctgcgccccagggagacccaaaagcgcctcttaaggcgctgatatttgattccctgtatgattcctacaagggcgtcattgtcttctgcaggattaaggaaggcagcgtaaagaaaggcacgccgattcagatgatggcaacgggtgcaaaggcggaagtcgtggaagtaggctacttcggggccggacagttcattccttgcgacgagctgaatgccggaatggttggctatattactgcaagccttaaaaatgtgaaggatacgcgggtaggcgataccatcacagatgcatcccggccatgcgacaagcctctgccaggctataaaaaggtcaatcccatggtgtactgcggcatgtatccggcggacggggcgaagtacccggatcttagggacgcgctggagaaactgcagcttaatgatgcatccctgcagtttgagccggagacatccatagcgctgggcttcggattccgctgcggcttcctggggcttctgcatctggagattatccaggagcgtctggagagagagtataatctggatctggtaaccacggcgccgggggttatctataaagtatacaagaccaacggggaagtgatcgaactgacgaatccgtccaatcttcctgacccgtcggagatcgaatatatggaagagccaatggtaaaggcagagattatggtgacttccgagttcatcggcgcgatcatggatctgtgccaggagcggcgcggcatctatgaaggaatggagtatatcgaagaaacccgtgcggtgcttcggtatcatctgcccttgaatgagattatctatgacttctttgatgcactgaagtctcgttccagaggctatgcctcttttgattatgagatggacggctacgtgcagtcgaatcttgtgaagctggatattctgatcaacaaggaggaggtagacgccctttccttcatcattcacgcggatacggcttacgagcggggccgcaagatgtgcgagaaactgaaggaagagattccgaggcagctcttcgagatcccgatccaggcggcgatcggtagcaagattatagcaagagagacggtaaaggctatgcgaaaggacgtgcttgccaagtgctatggcggtgacatcagccggaagcgaaaacttctggagaaacagaaggaaggcaagaagcgcatgcggcaggtaggcaacgtggagatcccgcagaaagcctttatgagcgtattaaagttggatgataaataatgaggccattagaattatatattcatattccattttgcatcagtaaatgtaaatattgtgatttcctgtccgcgccctcgaaagagggggagcggcaggagtatgtgaaaagcctttgcaagcggatccgttcttacaggacgctgacagaggcttatcatgttgtaagcatatttataggaggagggaccccctccctccttgttccggcacaggtattctccatatttgatgcggtacgggagacgttcatggtggacaaggatgcagagatcaccattgagatgaatccgggaacggtatccccggagaagctgattgcatatcgccaggagggaatcagccgcctgagtatcggactgcagtccgtccgaaacgaggagttgaaggtcctgggaagaatccatacatttgaggattttcttcatacctacgagatggcaagaagagaaggatttggaaatatcaatattgacctgatgtccgggataccgttccaaaccctggacggatggaaggaaagcctggaaaaggtggcaggccttgggccggagcatatatccgcctacagcctgatcatcgaagagggaacgcctttctatgagcgctaccgggatgcgaggcatgaggaagaactgccggatgaggagacagaacgccagatgtatcattataccagggagatacttggggcgtatggctatcgtaggtacgagatatccaactacgcaaaagaaggctttgaatgcaggcacaatcttggctactggaaccggaccgaatatctgggaatcggaaccggcgcggcttccctgatcggcagcaggagatggagcgaaggagaagagccggaggaattaagccgggaaaaccagatggaagagtatatgtttctgggacttcgcaagatggaaggcgttacaaagtctggattcctgaaagaatttggctgtaccatggagagcaagtatagccgcgtgcttaagcggatgtatgccgaaggcttaatggaggaagcaggggattatgtaaggcttaccgaccaggggattgatatcagcaattatgtgatgagcgaattcttattctgatcatgagcgttataaggagccgtaaaggaacatgcaagataaggagacggacgaatgtattttgaatatggtgatacagagattgaatacctgaaaagaaaggataagaaattaggagaagccattgatcatatcggacacatctaccgggaggtggacgcagatatcttccagtcagtggtgcaccatatcataggccagcagatatccaatgcggcgttggctaccgtgtgggggcgattcaggaatttggtgggagaagtgacggcggacacggtcttaaaatatcaggcggaggaactaaaaggtctgggaatgtcgcttagaaaggccgagtatatccaaaattttgcccaaaaagtctgcctgggagaactggatctggaggagttgtaccggatggatgaccagaaggtgatcaagaccctgtcatccctgagggggattggcgtatggacggccgagatgcttctcatcttctgcatgcagaggcctgacgtgctaagttatggggacggcgcgatcctgaaaggaatgcagatcctgtaccatcaccggaagatggataaaaacctgtttgagaagtaccggaagagatatagcccatatgggacggttgccagcctgtatctttgggccattgccggccaagccctggagaaatgatagtgggagcgccgttaaaaataagattaagaataagagccttcctggtttgaagaccaggaaggctcttgccgttaaggttacattttcagtacgattccaatgaccgctccggccaggatccataaaatgggatgcagttttcccagtttctttacctgcagaagcaggaaggttccgaggcatatgacgacgctggtcacgttgatatgcaaagaaccattcacggtagataccagggcgatctttaacagttcccataccgcgtagccgatcagggctgccacggtagggcggatgccatagaatacggcctttaccgtaggattctcgctgaaattctcaaggaaccttgcgatgatcacgatgataatcagagcaggcgccgtcagcgccagggttgccaccagcgcgccagggatgccggctacgctgtatccggcaaaggtagccatgttgatgcccaccgggccgggggtactctcgctgatcgccaccatgttggccagatcgctggcagtgtaccagtcgtatttggtggtcaggtccataaggaatggcagggtggccatgccgcctccgatggagaacaggccgatcttaaagaattcaaatgccagtgtcagataaatcatgattctttccgccctccaatctttttgatgacgactcccgcgatacccgccaggatgacgatgacagcggtgggaacgggggtaaagcatgccagcaggaatgctgcgacaaatagcagggcgcccagcctatccacaattcctttctttgccatggtgactacggtattgagcatcagcgcgcagacgacgatccgaatgcccgccagagcatgaaggacgacaggaagatggatgaagttctgcaggatggatgccaccaggcagatgatgacaatggagggggagataacgcccagggttccggatacgccgcccaggaatccggcctgcttgtagcccacataggtggcggtattgacggcgataatgccgggcgtgcactgtccgatcgcgtacatatccagcagttcctcgtcggtgcaccattttcggtcttccacgacctccctctggagcatgggaagcatggcgagccctcctccgaacgtaaggccgccaattttaaagaaactgatatagagttcagccattttttttaatttcatagtaatacctcgctgcttgacttttaaagtagatgagacatgattaaggcatagacttcctgattttttttcgcccagttgttggcgatcgtctcagcctcggcctgtgtgggaacagacagcgtcaggtcgatcagaggagtatcctgctcaatgacctggcaacggacagaatattccatgttggaattccggtaatagtctgacttgacggccacttcgttttttaattcgtattgcttttccttcaggaaagtatcgatatcttcctgaatagcaggagaaatatcatttttgaagaaatgtatcgtctgtgccccttcttccgtgaggtggtagaacgtacggctgtgggtcgattcctcatgaatgaagccggatccgatcagttccgatattgcctgctggagcttaaagtaggtggtatatccctcatccagaataaattccgatatctgggaattggtcagggggaagtctaccttgttcagcatgtagagtatgattagtttatatagtgtaaaagatttggccattgttacaactcctttccttgccagatgtcctgctttttaaagtatgcctgcatctggttcaatacctggcgcttattccctgtccataagggggctatcaggagtggcttgggaccgtctccggtcagccggtgtatgacgatatccgggctaagggcgcacaggcattggcctaggattccaaaatattcttccatggaaggaaggtagaatggatgcttttcataatagcctgcaaggtccgtattctttagtatgtgcagcagctggaacttcatgccctggatatcctggcagttcaggtaccgcaccgtgcgcagcatcttttccatatcttcgccgggaaggcacaggattgtatggacaattacgtcaatgttcagcagacgcaggcgggatacggcctgctcaaataccggaagatcatatcctctgcggatgaagcgggctgtatcaggatggatcgtctggaggcctaattcaatccagacaggcttgatctggtttagctcatccagaagtttaagcacatcctctcctaagcaatccggccttgtggcaatggagagaatctttacctcgggatgcctgatggcctccataaacacatcgcgtaaataggcaactggcgcataagtgttggtgtatgcctggaagtaggcaatataggaggtgcctggatgtttggcggcaacctgccttttcccctgctcgatctgttccgtaatggataacttgcggtcagatgcaaaatcgccagaaccgccggcgctgcagaatacgcagccccggcgtcccagcgtgccgtcacggttcgggcaggtcatgcctccgtccagagagatcttatacagtttttctccataagtattcttcaggtaatgatccagagagtagtatctcttatcaccccagcgtttgaccatactaaatcagttcctttactgcctggctgacaacatctgcaacgcgcggatcaaaggcttccggcagaatgttgtcttcgttcagctcattttctggaatcagcccggcaatcgcctttgcggtagccagtttcatctcttccgtgatcctggtggcgcgtccttccaaagcacccttaaagattccggggaatgccactacattgttgacctggttggggaagtcggagcgacccgttcccacaacttttgcaccggcttctttggcaagatccggcatgatctccggaactggattggccatggcaaagaggatggaatccttattcatggaagccaccatctccttggtgacaatgttgggggcagagacgcccacgaagatgtcagcgcctttcaaggcatcgctaagagttcccttcctgccttccagattggttacctccaccatcttttcctgcatccagttcagatgcggggattccttgctgaggattccattgatatcgcacatggtgatatgcctgaagccgtaggtaagaagcagcctggtgatggcaactcctgcggaaccggcgccatttaccacgaccttggcctcttccttgttcttgcctgtgaccttcatggcattgatgatgcccgcaagaaccacgatggccgtgccgtgctggtcatcatgaaagacgggaatatccagcagttcttttagacgctcttcaatctcgaagcagcggggagcgctgatgtcttccagattgatgccgccgaacgcgggggcgatgttgacgaccgtgcggatgatctcttccgtatcctgggtatccaggcagattggaaacgcattgaccccgccaaattctttgaacagtacggcctttccctccatgaccggcatagcggcatgggcgccgatgttgccaagtccgagcaccgcgctcccgtcggagacgacggctaccgtgtttgactttatggtataggtataagcagcctctttatctttggcaatggccttgcagggctccgcaacgccaggagtgtaggcaatagacagatcctcgcgggaatgcacatgggattttgcggtcgtctcgatctttccatgccattcctcatgcattttcagtgctttttcatttgttgtcataggattaccacctcttttattttcttcttattaataagttttataagtccgtattttttataatagcattcctttagcctcaaatcaataaagtttcaggaaagttttgaggaggggcaggttaagaaaaggggggcggcgcaaacagaaaaatccgggattatgtcgcgattttttatgttttgtcataaaaactcggatataacatggtttaaaagaggcgaattataaagaaatacttttaaaatcaagattattgtagtataatactttcatatttcagatgagtcaagtcagactggtgttcccgatatagataattttggtgaatatgaaaggaataaatgatgatgagagaaaagtatgaatcactgcctttagctacgttaaaagatcttgccaaagcaagagggctcaaaggcatatctacgatgaagaaggcagagcttattgagcgcatgctggaagaagatgaaaaggaaaagcaggcttccaaggagacggtaaaagagatgtctgccaataccggagataaggagatccatgatattgacaggctggacagcggagtgatcgctcatggcatcctggaagtgcttccggacggatatggattcatcagaagcgccaactatctgccgggagagaatgacgtctatgtatccccatcccagatacgcaagttcaaccttaagacgggagacatcctggaaggccataccaggattaagacgcagcaggagaagttcagcgccctgctctatctgacccggatcaatgagatggacccgatgagggctatgcgccgaaccaattttgaagatatgacccctatcttcccggatgaaaggctgcggctggagtgtggaaggacaagcaccgccatgcggatcgttgaccttctgtcgccgatcggaaagggacagagggggatgatcgtatccccgccaaaggccggaaagacgacgcttctgaagcaggtagccctgtctgtccgtcagaataatccggagattcatctgctgattcttctgattgatgagcggccggaagaagttacggatattaaggaagccattgagggtgagaatgtggaagtcatctattctacgttcgatgaacttccagaacatcataaaagagtgtcagagatggtgatcgagcgggcgaagcgcctggtagaacacaaaaaagacgtcatgattcttttagacagcattaccaggcttgcaagggcttacaacctgacggtaccgccatcaggaagaaccttgtccggaggtcttgaccctgcggccctccatatgccgaagcggttctttggagcggcaagaaatatgcgcgagggcggaagccttaccatattggcaactgcgctggttgataccggcagcaagatggatgacgtcgtgtatgaagagtttaaaggaacgggcaatatggaactggtgctggaccgtaaattatctgaaaagagggtgttccctgcaatcgatatacccaagtcaggaaccagaagagaggacctgctgcttagcagggaagagcaggaggcagtggaaactatgcgccgggcgctgaatggcatgcgcgcggatgaagccgtggacaatatcctgaatatgtttacccggacccgcaataatgaggacctgatacaattagtaaaaaagacaaaatttatctagacaaggccgcgcttttatgatacaataacaacgctgtttagataacgaacatttatcgcacatcgtgcatgtgacaaaataaagaagaggtgaaaatcatgaaagaaggaatacatccagcatatcatcaggcaacagtaacttgtaactgtggcaacacattcgtaacaggatctacaagcgaagacatccacgtagaaatctgttccaaatgccatccgttctatacaggacagcagaaagctgctcaggctcgtggccgtgttgataagttcaataaaaaatacggaatggacaaatagtttcacaagtatcgggttgaggttgtataatctcaacccttttatgttgcagaggagttctatatgaagtcatcaaatattggcggacaggccgtcttagagggaatcatgatgaagcacaaagatgcctactccgttgcagtgcgcaagccggacggggagattatcgtgcagaaggatgagtaccacagcattgtgggaaagtggaagaagctgactacgattccgtttatcaggggaatatttaattttatagattctatggtgcttggcattaagaccttgacttactcagccagtttttatgaggaagaagaggagcaggaaaaacttacggaagcagaggctttgaaaaaggagaagcaggagaaatggctgatgggcggaacggtggcgttttccgtggtagcggcggtagccatctttatggtgctgccttacgttctatcctcgtttcttaagccgctcattccatcttatcacatccgcacagtgatcgaaggctttgtgagaatcgggatattcatactgtatgtgcttctgatatcgaggatggaagatatccagaggacattcatgtaccacggggcagaacataagtgcatcaactgtatcgagcacggcctgcctctgacggtggagaatgtaaagatcagttccaggcagcataagcgctgcgggaccagtttcttgttctttgtccttgcgatcagcatcattctcctgctgcttgtacaagtggagtcacccctcatgcgggtggcagtcaggattgccctccttccggtgatcgccggaatctcctatgagatactcaaactcgccgggagcagcgataacgcgctgatcaatctgttcagcaagccggggctggcaattcagaaactgaccaccaaagagccggatgagggcatgatcgaagtggccatccaggccgtggaggcagtatttgattggagagcatatgaagaagagaactttgacgcttcagcagatttatagggaagggacttccaagcttaaagaggctggcatccgggaggcagcgctggatgcgtggtatctgctggaatttgcgactggaattaccaaagcttcctattatggcaacccggataaagagataaaggaagaagaggcggcccggtatcttgcgtatatagagagccggaagaaacgaatcccattgcagcatattacgaaggagcaggcgttcatgggctatctcttctatgtggatgagcatgtgctgatcccaaggcaggatacggagacgctggctgaagaagcgctcaaggtattaaagcccggcatggaggtactggatctgtgcaccggatccgggtgtatcctgataagcctgatgaagatgtgcgaggggctttatggaaccggaagcgatatatccgaagaagcgctggaagtagccaggaagaatgcctgcaggctggaagtcaatgcaacattcataagaagcagcctgtttgagcatatcagtggcagatacgacctgatcgtatccaatcccccttatatccgcacatcggttattcaggaacttcaggaggaagtaaggcttcatgatccattcattgcccttgacggcaaggaagacgggctgtatttttacagggagatcatcaaagccgggggaggctatctcaagccgggaggctatctgatgttcgagatcgggtatgaccagggaacggaagtggcaagccttatggagaagcatggatataggaatataatggtaaaaaaggatttggcaggtcttgaccgtgtggtttcaggcatgtacaatggagaatagctgttaggaaaatgttaaggaggaaatagtatgtttgacaaattagaggatttgctcattcgtttggaagaggtacttagcgaactacaagagccgaatgtggctaatgaccagaaccggttccgcaagcttatgaaagaacagaatgaactgactcctattgttgaggcatataaggaatataaggcctgcaagcaggcgatcgaggacagccttcagatgctggaggaagagtccgatgaagagatgagagagcttgccaaggaagaactgaatgactcaaaagcgagggttgaggaattagagcatgaacttaagattctgcttctgcccaaggaccccaatgatgataagaatgtcatagtcgagatccgtgccggtgccggcggggatgaggcggccttgttcgcggccgagatctaccgcatgtatctccactatgcagagagccagcgatggaaagtagaactggtggaatgcgaagagatcggtataggcggcatgaagaatgtgaccttcatgatcaacgggaaaggagcctattccgtgatgaaatacgaatccggggtacatcgggtgcagcgggtgcccgagacagagtccggcggacgtatccatacttccacgattacggtcgctgtcatgccggaagcggaggatgtagatatccagatagatgaaaaagatatccgtattgacgtcatgcgggcatccggcaacggcggacaatgcgtcaatacgacggattcggcagtgcgcctgacccattatccgacaggaatcgtaatctacagccagacggagaaatcccagctgcagaataaggaaaaggcattcgcccttctccgggcgaaactgtatgatatggaatgccagaagcgccatgacgcagaagctgaggcgagaaagagccagattggtaccggagaccgttctgaaaagatccgcacctacaatttcccgcagggacgcgtgacggatcatcgtatcggcttgacgttatataaactggataagatcatgaacggcgacatccaggagattattgatgcctgcatcgcagcagaccaggcggcaaaactggcaaatatgaatgagtaaggcaagacaggaaaaggcgcagcgtgatgaagagtcacgccctgcgcctttgctatatgaggaaaagactatgagagaaaaactgaaaaaattatttgcatattataacccatataaaccgctattctacagcgatatgttctttgcaatcctgggggcggccgttacgctgattcttccactgatcgtcaggtatatcaccaacgaggtggtttattttaacggagcagatgccagacgggcaatcctggtgcttggaagcattatgatcgctctggtgctgctggagattttctgcaacttttacatcgcttattttggacacattatgggagcgaagatggaagcagacatgcgcggggatatcttcggccattaccagaaactgacttttgccttctatgataaccagaaggtgggacatcttttatccaggatcaccagcgacctgtttgatatcagcgagctgctgcatcacggtccggaggacttggtaatatctatcatcaagattataggatcattcatcatcctgctgatggtaaatgtgaagctggctttggtggcattcgcgtttatcccggtgatggcactatttgccttctactacaacgggaagatgaaaagcgcttttaagaggaaccgggaaaagattgcagatatcaacagccagatagaagacagcctggcaggcatccgggtagtaaagtcttttgccaacgaaaaggaagagatgaagaagttccaggcaggaaatgacaattttgtggcagccaagaaggtcagctacaaatatatgggcatctataattccggattgggagccatgagcacgctgatcacggtggtagttcttttggcaggagtggggatgatgctggcagatacggtaaaactgacagacttgatcaccttccttctctacatcaacaactttacagatcctgtgaagaaactggtatccttcacagagcagttccagaatggatactctggatttgagagattccttgaaatcctgtcgatcgcgccggatattgcggacagaccggatgcggtatccgtagatcaggtaaaaggagagattgaattccgggatgtatccttccgatatgaggataatacggaaaaggtgctgaaccatattgatctgaaggtaaacgcaggagactatatggccctggtggggccttccggagtgggcaagaccacgctgtgcagcctgattccgagattctatgaagtgacttccggcgcgatcctgattgacgggatggacataagggatatcaaactggctgatctgcgtaataatatcggaatcgtgcagcaggacgtgtatctgtttgcggggacgattatggataatatccgatacggccggccggacgcgacggatgaagaagtagtccgggcagccaagaatgccaatgcccatgaattcattatggctttcccggatggctatgatacggatatcgggcagagaggcgtcaaactgtccggcggacagaaacagcggctgtcgatcgcaagagtatttcttaagaacccgcccatactgatcttcgatgaagcgacttcggctctggataatgagagcgagcaggtagtgcaaagatccctggaggggctggcaaaggacaggactaccttcgtgatcgcccacaggctgacgacgatccagaatgcccagaagatactggtacttacagaggatgggattgccgaagaaggaacccatgaggaactgcttaagaagaagggaatctatgagtcgttgtaccacaggaatttcgaggcctgacatacttttgtcatcatataaaaatatagtttaatatagtttaacagcgtagcggttatagactgctacgctgtttttttgccatccaagggcatcctatgtattctgctattcttccttccactcatccttgatcaagtaatcttttaatgcctgtatatccttgacgatcaggtatccattttctttttctatcaatccctcattcgtaagcgacagaaagatattcgagaccgatacgcgggaaaggcctgtctgataggccatctcctggtgcgtgaatttgatattcagcttgtagctgccgtctcttagccggacgccatatagctggatcaggctcagcagcgagtggtagacccggtaattggagtcattaaaactcatctgctctaatagacttgtgataagacgagtcttcagtgacagcgcctttaataaggtcatgcaaaaatctggattctggcatatctcttcagtgaaacgttttttggaaatcagatacagcgtggtttttgtacaggttgttgccgtacagtaattgcccagctgatccagacaggcaagctcgccaaagcaggtgcccttgtccgcgatatagatgcttcgcctccggccattgatgccatagagatcgagcacgacccggccttccttgacaagatagacgtaaggagtgacatcgccctgctgatagatgacggtgcttctttcataggacttgacggaggaatccttaagaatgggctcccagtccttgtcatcaagactcagccatggagacatgtagggtgcaatcaaatcagataaattatttttagtcaatattagaacgctccttttagtagtaataattacagaaaatgacccaatattccgacgattaaagattgttaaataataaatcataaaattaccgtggtttgtaaagtagtttacagaaaaattatagcatgattactataattgtcaatatgaatcaattagtgcaattgacagaatattaaacgagaaaggagatgagaacatggcagagattgaccggtattcttttatctacggcatgattgcggcctttggagaatgcgtagcccaggaggtgaaaaaagttgcattcagccctccatttcccccttctgatttgaaattattggaggaagaggccgagaggatcatgagagagcagggcttgtcttactgtctggaagaaaatccggatattccggaggatgaaagggtgtactggtgggttctgtacaaattccccgaggttcgaaacgaatatgagaggctaaggcagaaaggattgaatccggcatgggagtttgaagcgtttaaagaattattgagttatggaacagcctgggggcccgggcatgagaaggtggtcccgaaaatcagaaaggaggccagcccgatggatccggtgacaagaatcttgtttaaggacggcggatggcctgtgaaaaggaaaatataaaggaggatatggtatgaactcatttggctttattgagacgaaaggatttgtaggcagcgtggaggcggcggacgcaatggtgaaagcagccaatgtagaggtggccggaaaagtagagattggcggcggatacataaccgtagcgatcaaaggcgacgtaggagcggtaaaggcggctgttgatgccggagccgaagcagcgcagagagtcggagaactggtgagcgcccatgtgattccaaggccgaacgaaggcctgctggatctgtttctcgaaaaagaggaggcgtaggctgcgggattagacggcagcaggaaaggagttgtaacgattgaagaaattttatacagcagcagatgttaacttttatgcttccaagggcgagagcgtcatctatatcaatccaggggatgtagtgacctctgtggcaagggaagaagcagagaaaaagggaatccggttcgcggcgggagaagcgccggcaccggcaagggcacagcagccggcagccccatacgcggcgccagtgcaggcacagacgccctcataccagaagccggcggccgtggcagtgccagcggcaccggtaccatcctatacctatccgcaggtgaaggcgctgccatataaggggcttctaagcgaggcggaggttgataggtggagggaggacttcccgattcttaagaccgtggcccatcttggcaactgctcccagagcgcgcagtcaaaacaggtgctggcgggcatccagagatatctggataactggggcagcgtcggcatggactgggattcctggatggaagagatcgagcttgcgaaggctgaattcgccaagctgatcggcgcgcagccggatgagatcgccatcgcttcctccgtgtcagaccttgtaagctccattgccaattccctggattataccgggaaacgtaagaaagtggttgtgaccgatatggagttcccgacggtggattacatctggctcgcaaaccagagacacggcgcgaaggtggactttgtgtctgtcaatgagaaccatgagatcgccatcagcgaatatgaacgctacatagacgaagatacgcttctgacatccgtaacccaggtgtattacctgaatgggttcaagcaggatgttaaagcgatcgcagatattgcccaccgcaaaggctcgctcgtactggtcgacgcataccagtgcctgggaacagagccgctggacgtgaaagccatgaacatcgacattctcgtatcaggctgcctgaaatatctgttcggaatcccgggcgtggcatttatgtacgtgaacaagcagatcatacaggaactgaagccttctgtgaccggatggttcggccagacgaatccattcctgtttcagaccagatatctggactgggccaacaagacgagccggtttgatacgggaaccccgcctgtgctcaacgcatatgcggttcgggcaggtcttgagattatcaacgaggtcacggtgccaaagatcaaagacaggatcgacatgctaagcgctcatgccctaaacggcgttatcgcaagaggccttaagaccatcagtccctttgacgtgagcaaaaagggcggtacgacggccatcgtctgcggagacaaagtggactcccatacgatggaaaaacttttaagagacagaaatgtgattggatcaggcagaggcgaagtgatcaggattgcaccacatttctacactaagccggaagagatcgactacgcgctggattgcatcaaggatatcctggaaggaaggtaggtgcttgctatgtacatctgcaaagtacaggggaaatgtgtttccacgatcaaggatgagcacctgaaaggctgcagcctcattacaatgcagcggatgaacaaatccggcggtccatcgggcgagatgctggtggccgtagataccatcggctgcagcgtgggagagaccgtgcttgtgacgagaggctcgggggcccgggcggtactgggcgccgacagtccggctgacatggtcgttgtgggaatcgtagacacttatgattgtaaatgagaaataggaggatggaagatatgaagtcaaaaggatttattgagacaagaggactggtagcggcaatcgaggcggcagacgcgatggtgaaggcggcaaacgtgacgctgtcgggcaagaagatgatcggcggcggacttgtgaccgtggtcatcgaaggcgacgtaggagccgtaaaggcagccgtggatgcaggggcagcggcagcacagaaggtaggagaactggtgagcgtccatgttatcgcaaggccggatgctgagatcgacgcgttccttaattaaggaaggtgccttatggaagaagcaaaaaaagaaaatctaaatctgaggacctttgtaattgttgacaatatgcagccccagtacgcggctgtgacaggaaccgtatccaaaggagacatcccgcttgcggggatgagcgaactgtacatagaactggcgccgggaagcggagtgtatgatctgctgaacgcggcgctcaagtcctccaacgccaagcctgccttccagatcgtggaacgggaatacggagagatcgaactgcattcttattctccggaagatgtcaagcaggccggggaggcagtgcttgaagcctgcgggcttacagtgcaggaccgtatgaagcccaagatcgtgtccgagcagatcatctctaatacagatgcctatcaggcacagctgatcaacagggattccaggcatggctcgatcctcgttcctggggagacgctgttcatcatggaagtagagccggcggcctatatctctatcgcggtaaatgaggcggagaagaacgcggacatcaaagtggtgaccttcgacccggtgggacggtttgggagaatgtatatctccggctcccagagcgaggtcagaagcgcaagggacgcggcaatcgcggcaattacaggtgtggaaggaagaacatagcctatgggtaacgacatatttgcagattatatcaaaaacctaaaacagaataacgaatctgcccgccccactgtgccttacgccgtaggccgggagaacgtaagcgcaggcggaggcagcgagacgctggacgtcctcaaagagatcagccagaagcttaccgccatgcagaccgtccgggagccgcagacaaaagatcaggcggatcttgcggtggcgggcggcatggtcgtgctgccgggtcacggcgtctttaaggccgatgtctatatcaaagatggaaagatccagtccctgagccagggaggagaagtccgtgcggcaaagaccatagacgcttcgggaaaatatgtctgtcccggcctcattgacccccatgtgcatctggggctgtttgccccgatggagacggatatggcctcggagacgaaggccgcggtcatgggaggcatcacgaccaccggcgtatttttcggcggccctgcatcccacttttctacatttccggagatcgaggagcaggctggcagatattcttacacggatatcattccccaccttgtgatcggcaatgaagagcagatgcgggagatacccgattacgcccggtactttggcgtgacatccttcaaggtgtatatgaacgggatacccggcatgatcccaagcgtggacgacggattcatcctggatgtcatggaacagatgaagcgtacgggaaagcagtgcatcctatgctgccacacggagaatacccatatcgtagccagggcgcttcgggacgcgaaagagaagtacggggaaggcgcggacgtaagagactggatggaaagtcatccggcgatggccgaggaagaagcggccatgcggatcgcttatctggcagagaaaagccggactccggtgtaccttgtacatatcggcacgaaggagggcatcgaaaaactgcggcagatcaagccatttaacaaatatgtacatatcgagacgacaagcccttatctggcggtgaccagcgagcagtttgacgggcccctctataagatggagccgccgcttcgaaaccaagacgacaagaacgcgctctgggaggcgctggatgacggagtcatcgacacgatcggaaccgataatgtatgcgagagcaaagaagaaaagcagccggagcgttccatctgggacgtggttccgggatattccgtagtggagacgcatctggcgtcggtattgacggaaggcgtggtaaatagaggaatcaacatcgaaaaaataatcagccatatgacaaaatgtccggcagagacatttggcgtatatcccaagaaggggacgctgctgccgggaagcgacgcggacctggtactcatcgacatgaacgttacacgggaagtacatgccaaagacctgcattcccggtcagacttttccatctttgagggaaggcggcttacaggatggccggtgatgaccgtcaaaggcggcagcatcgtgatggagaatggaatgctggtggcagacgcgccgtcaggacatatggtgaagcgataggaggtaacttaacttgaaagagatcagaatacatggcagaggcggcatgggcgcggtaaaagcggcagaggcgctggtgtacgcggcggtgatggatgggaagtatggcaactcaatcccgttctttggatttgagcgtcagggagcgccggtcacagcctttgtcagaatcagcgaagaacccatccggccaaaaaacagggtgtaccatccggacattatcatcgtgctggatcctacgatcatgaacgcggtcaacgtgtttgaaggggtcaaagaaggcggcatccttgtgctcaacacgacccatgatccaaaggatatggagataccaaaaaacattgcatccgtcaccgtggtagatgctacaaagatcgcccttgatatgattggcaggcccattaccaatacggttatgctgggcgcgttctgcaaggcgacaggactggtatccgtggacgaggtggccaaaaaagtagaagaactctggggcgccaaaaacaaagaggcgctgtacaaagggtatgaggccgctgtgacggccgaagcgcgataaaggaggtgctctgtaaaaatggaatttaaaagtaaatatattgtgcctgtaggagcggatggaatccatgttctgaatacaggcgactggaggacgcagcgcccggtgcttgaccaggaggcgtgcatcgcatgcggcacctgccttctgtactgcccggtaaactcgatcagaaagtcagacggaaaattcaccatctgctatgactactgcaagggatgcggcatatgcgcgcatgaatgtccgaaaaatgcgattacgatgataccggaggaggggaaataaatgcagagattagatgtattaaatggcaatatggctgcagcgctgggagcagccctcgcaaaaccagatgtcatcgcggcttatccgattacgccgcagacaccggtagtagagtatctcacccagtttgcggcagacaaaaagatcgacgcggccatgagcgaggtagagtccgaactgtcagccatgagcgtggtgacaggtgcctccttagcaggatcgagaaccttcacggccacggcgtcccagggactttcgcttatgtatgagccttactttcgggcatccacccttcgtctgcccatcgtgatggccatcgtcaaccgggagatgatctccccccagagcgtgtggggagggcagcaggattccatgagcgttagagatgcgggatggcttcagatctatgcggaagacaatcaggagatcctggatctggtggtgcaggctttcaagatcgcggaagataagcaggtactgctcccgatcaatatctgctacgatggattctacctgtctcatatgaccgagcgtgtgatggtgccggagcaggagaaagtagatgcatttttaggaacttaccacccggaacacattatcctggaccccgagcgcccaatggcggtggatccgctcaccaacggcgctcttttgatggaatacagatacaaacatctgaaagcccagcaggcagcgcttgaggtaatcgaggaagtggaccgggagtacggggaattgttcggacgctcctatggaggcgccatcgaagaataccggatggaagatgccgagtacgccatcatcaccaccggctccatgtccggcgcggcaaaagatatggtggacgcgaaacgtcaggaggggctgaaggcaggattagtccgaatgcgcatgatccgtccgttcccgaaagaaaggattcaaaaagcgcttgcgaacgtaaaagcctttggagttgtcgataagaatgtatcattcggctgtgacaccggaatcgtatatcaggaagtaaaagcagccctgtacggaggaaatgcggtaccgtcagtgccggtcatcggcggacttggcggggaggatatctcgcttcggatgatgggagacgtcatcgacgcagtcgtccgcgcggcagaagaacaaacggacagcgagaccatatggctcatggtagaagaagggtaggtgaagaagaatgaatatagtagacaaattagcgtccaaagaggatatggtctctccaggcatatcggcctgtgtgggatgcaacgtggaactgacgcttcgaacatgcatgaaggtgctgggacctaacaccatctatgcggtgcctcccgggtgtatgggaggagtaggcgttgtaggatgggatacgcagtccggctcaaagattccagtattcttcccgctgcttgacaatgtggcatccatgctggcgggcatcaagatgcactatgaaaagcagggcagagatgtgaacgtagttgccttcgcgggcgatggagcgtccacggatgccggcatgcagtgcctgtccggcgcggcggagcgcggggacaaattgatctatatctgctacgacaacgaaggatatatgaacacagggtatcagagaagcagcgccaccacgaagtattcatggactaccacgacgcccataagcaaagaagggcggggcggcaaaaagcagcacaagaaagacttcccgatggtgatggccatgcatgatatcccatatatggcaacctgttcccctgcctatatcccggacatggtaagaaaactcgaaaaagccatggaggcgtcaaagaaaggcctggcttatctccacgtattcaatccgtgtctgaccggatggggcataaagccggatacgagtatcgaggtgtcaaggctggctgtggagacgaactttttcccgctctatgaagtggagaatggcacatttacgatcaacaagacattcaaggagccaaaggcggtgaaagaatacttgagccggatgaagaaattcaagcatctgaacgaagatgagatagcggaaatccaggaactggtggattacaaatggaaccggcttacgaagcttgccgacctttaacaagaagaaggagggaatacatgggacacaatttagacgcattattcaatcctgagaacattgcggtgatcggagccagcaataatccattgaaagccggctatacggtcatctacaacctgaatcagattggatatccaaaaaaagtatttcccgtgacaatgtcggctgacgagatcctcggacggaaatgttataagaagctttcccagattgaagatacggtggaactggtagtgctgggaactccggccaagatgatctatgacattatggatgacctggaagcgcgtatggaagagcggcaggatgtgaaggtgatcgtttgcatcgccgcagactatggagagacaaagacagaagaaggcattaaaaggcaggaatgcctcatccagacggcaaaaagatacggcatccgggtggtggggccgaactgcatcggcatcatcgacaatattaaccgcgtggacaccacatttgtggagacgcttattccaaaagaaatgagagggcagaagggaggaatcagttttatctcccagagcggagcgatggcggcttccatcctgatgatgggagcgtccggcccggcgccgatctccatgaacaaattcatctccataggaaatatggcggatgtggactgtatcgacctgctggagtactttgagcaggatgaggacacgaaggtgatcggcatgtatctggaaggatatccggatggacgaagactgatggatacgctgtccaggattgccaggaagaagccggtcgtcatcctcaaggtagggcggagcagcatcggtgcgaaggcggccaattcccataccggctcccttgccggggctgattccgtctatgacgcggcattccggcaatatgggattataagggtgtacacgattgaggatatgatggatacgcttcaggcattcgacgccatgaagataccagaggggccaaactgttttcttcttacacaggcaggcggtccgggaatctattgcacggatgcgttcgtggatgaaaagaaccttgcatttcccatggtatccgatgtgacgaaggaaaagttgaaggaggcgctgccgcctatggcaaatatctgctccccggaggggtacgcggacatcacggcagcagctacggtagcgcatcatgtggaaagccttcggatcgtcatggatgacgaggcgacggacagcgtgatcttcgtcacggtggtgcctacctttcttccgagaagggaactggccgaggggctgatccatctgctggtggaggaaggataccagaagaaaaagccagtctgtatctgcatcatggcgggaaactatgtgtgggaatgccggcagatcctggaacgtgccggaatccatacgtttgacacgccagcccactgcgtgaaggcaatgagccatatgacggcctatggccaattcttaaaggagcaggaggaagaggcagatgagtagatttttaaatgaactggatgcgaagaaccttctttctgaatacggggtgcctatggcaaaaagcagggtggccgcatcgaaagaggaggctgtggggattgccagggaactggaatttcccattgtcatgaagatattatccgcggacatccagcacaagacagaagcaggctgcgtctttctcggcgtggaaaaggaagaggtggaagagaagtacgcgcagatcctggagaatgccaaagcctacaaggcagatgcagccatagacggcgtgctgatacaggagatggccgcagaaggcctggaggtcatcgttgggatgaagaaggatccccagttcggaccggtgatcatgacaggaagcggcggcatctacgtagaagtgttcaaggatattgcgctcaggctgcttccagtggataggaaggaagcagtgaaaatgataaaggagacaaaactgtaccagatcataacaggcgccagaggaacggaatatgatatggacgccctggcagactgtctcctgaaggtatcggaactcgtgggaaatcagccgtctatcgaggaacttgatatcaatcctttgtttttgtatgaaaaaggcaaaggggcgaaaggggtagatgcgctgatcaagattaccgaggagaaataaaatttgaagaaagcaggaattctgccttatacggcaggtattgtgatggcagtttttttcggcctgtcctttctggtgacgcagcaggggctggccgagattcccccgatggtcctgatgagtttccgatttgcgctggctgccgcctttatgacgatcttaagggcatttggaatcatacatatagattataagaataagccggtgaggggcgtgatcatactgtcagtgttttatcccgggatctcattcttttttgagaccatcagcctgaagtatgtatcatcttcccaggcagggatattggtctcgatcatgccaatattcgtgaccttgttcggcatcttgatattgaaggaaaaaccgatgggcatacaggtgttttttatcattgtatctgtgactggcgtgatggttacggtggtgtttgcaaagagcagcggaaatgaggggacgtttttcggcatcttgctgatgctcatatccgtactgggaggctcaattaataatgtgctctcgcggaaatattccacctatttctcatccgtagagatcacatatacgatgctgtgcctgggagccgtgatattcacatgcatctcgctcattcagggaatattcgaccgccaggtactggaagcgtatctcatcccgtttcgttccgggaagatgatgttcgtcgtactggaacttagcatcgggacatcggctgtggcgtttttctgtatgaattatatgctttctaagctgaaggcagtgaatgcggcggtgtttatcaatcttgcaacggtgatatccattgcggcgggagtgctcatcgtgaaggaacatctgtattggtatcaggctgtaggaggaatattgatcgtgctgagcgtgtgggggaccaattattttgaaaaccgtgtgaaaaatctaaaggaaaaggagggtgcatagaatggaagaaaagaaagaagaacgtttggaatttagaggaggtagttttttcgctgtactgccgcttatattgttcgtagttgtctgtatcatgctatttgtagtctttaaggtatttgagatggaaggcctgtgcatgggcggaatacttgtattaattataggaagcctttttgcaaagaactggggctgctactggagggcagttgtcaaaggaatgacatcggagatgatgaacacgctggcgctgatcctgctggtagtaggcatctttgctaagatgatgtcacgcggcggcgttgcccagggcttcgtctggcttggagattctatggggcttcacggcggcatgtttgtcgtatttgcgtttattgccaccagtattatatccatgtcaaccggaacctctataggaacgctattctcagggtttccgattctttatccatcaggaatcctgctgggcgcgcatcctttatatctcgcaggcgcgatcctgtccggagccatattcggagacaatgttgctccaatatctgatacgacgatcgcatctgcggcttcccagagttacaaaaataaaaagggaacggccgatatcggcggcgttgtagctacccgtatgaagtatgctcttgttgccatgttcatcgcatgcgtcctgtatctcgtgctcggcaacgcaggcgcaggagatccggcaggaaaagagattctggaagcatacaaggatccgaaagggctcatcatgctgattccggtcgtggtacttcttgccgtagccatcatcaaaagagatatattcattgcagtcacatggggaattatatccggtacagtcatcgggcttgtagcagggatccttacgcctgcagatatcgtttctgtggaagacggcgctttggcaggatttgcgatcgacggcattaagaacatgctgggaacggtgggttatctgtatgcggtagccggcattataggggtacttaatgaaagcggcatgatgcagaagatgatcgatgccctgctaaagagcaagttgaacaaatcgatcattggatcagaattcatcattggctttggaatcatccttacttccatctgccttggatcagccaatgggccggcaatcatcatgtatgggccgatcgccgacaagatcgggcaggagagcggacttcatccttaccggcgttccaacctgctggatggcttcgcaagcacgctgtccgtgatcataccattcaccagttcctttatctttatcgtgatcagctgcgtgaccgggctgatggaagagtattcctttattaatgccatcaatccgattgccctggcaggagcgaccttccactgtattgccttgtttgcagtatttgtattcgcggtactgacaggatggggaagagagtatgaagggccaaacggcgagcgcataaaagcgaagaacaggtagagaggcctcttggtaaaaaaataaatatcagggaaagaaaattacagtgtatggagctgttgcgctaaggccattagcgcaatggcttcttttatatggaaatcatctgtaaagtgatatttgaagaaattgtgctgcaaatatgtaataaatagaagaaaaaataaaaaaaatgtggtatactagaaaacgtgtaattaaaattggaaagattcaaagaaggtaaaatatgaaggaaatacagtttaagcgagcagaattagaggataaggaagttatttctcattattttaagcaccataccagcagaagctgtgagaggacatttgccaatgtgtatttatggtccaggcagtatcctgtcaagtgggcaatcgtggaagatgcgctggtattcaaaagcgaggatgagaagcatctggcatttgcatacccggccggagagccggagaatgtgaaaaaggcgctggaagtgcttatggagtacagtaaggagaggggcattcccttccagatgtataatgtaacgccggataattttgatatgctggaagaatggtatccgggaagattccagatcgagtataatagggatctggcggactatgtgtatgaggcagagaagctggcaacgctctccggcaagaagctgcacggaaagcggaaccatattaataaattcaagacgatgtatgagggacgctggtcttatgagagcgtgaccaaggagaatctggaggactgcttccagatggctctcaagtggcgcaatcagaacgggtgcgaggatgatccggagaaaagaggcgaaatctgcgtaacgctgaacgcgcttcgtctgtttgaagaattggaacttgcaggaggtattcttaaggtagatggagagatcatagcgttcacgcttggggagccggtctgttccgatacgttcgtggtccatatcgagaaggcatttgccgatatccagggcgcgtatcctatgatcaaccagcagtttgtagagcatgagtgccaggactatacgtatgtgaaccgggaagaagatacgggcgcggaaggccttagaaaagccaaattatcctaccgtccggttttcatggtcgaaaaaggaagagtaactgagcgtgcatagagaataaagaaaaggagaaaagattatgatagcagagaaaatgaagaacatggtagcaaatagttccgcaatccgggcaatgttcgaagaaggcaatcgccttgcggaaatctatggagcggaaaatgtatatgacttcagcctgggcaatccgaatgtggctgcgccggaagcggtgaaaaatgccattatcgaattgctggatgaagatgatccggtcgtgcttcatggctatacgaacagcaatgccggctatgcagacgtgagggagactgtggcggagtcgctgaacgcgcgctttggcactagttttgaaggcaagaatatcgtgatgacggttggcgccgcaggaggcctgaatgtcatacttaagaccttgctgaatccgggggatgaagtaatcgcatttgctccatattttggagaataccgttcttataccaataactatgacggggtgatcgtagagatctcaccgaatacgacggattttcagccgaagctggacgagttcgaattaaagatcacgccaaagaccaaggctgtcatcgtgaatacgccaaacaatcctaccggcgtagtttattccgaagagaccattaagaagatggctgctatcatggaggcaaagcagaaagaatacggcacggatatctatctcatcgcagatgagccttaccgcgagctggtctatgacggggcagaggttccttaccttacgaagtattatgacaatacgatcgtaggctattcttacagcaagtccctgtcgcttccgggagagcgtatcggatatctggtcattccggacgaagtggaagacagtgagacgatactggccgcggcaggcgttgcgacccgcatccttggctttgtaaacgcgccgaccttgcagcagaaggtggtggcgaagtgcatcaatgagaagacggacatctcttactatgacaggaacagggagactctctacaatggcctgaaggaatgcggattcgagtgcatcaagccacagggggcattctatctgttcgtaaagtctccggtttcggatgaaaaggaattctgcgcggctgccaagaagtataatattctgatcgtgccgggaagttcctttgcgtgtcctggatatgtgagaattgcgtactgcgtatcctacgacacgatcgtaaacgcccttccaaagtttaaggaactggcaaaagagtatttctagagggatgagtcatgaaggcatttgaaaagaacatacgaaaagttgagccttacgttcccggggagcagccccagcgcaaggtgattaagctgaacaccaacgaaaatccatatcccccggcacccggggttgcgaaagccttaaaagggatggagacggaccggctccgcctgtatccggatccggcagcgacgcctctggtggaggaactcgccagattctaccaggtgcagcctgatcaggtatttgtaggagtgggatcagatgacgtgctgtccatgtgcttcctgacattttttaattccgagaagccgctgctgtttcctgacgtcacctattccttttacaaggtgtgggcagaattataccggattccgtatgaatgccaggaactggatgaggacttccgtatagtgaaagaggattattacaaggagaacggtggagtcatcttcccgaatcccaacgccccaaccgccatctatgaagaactggatgtggtggaggatatcatcgcccacaaccaggatgtcatcgtcattgtggatgaggcatacatcgactttgcgggacggtccgcactggaattgattgataagtacgagaatcttctggtcgtgcagacattttcaaaagcccgctccatggctgggatgcggatcggatatgccattggcaatccggtactgatccaatatctcaatgatgcgaaatattcctttaattcttacacgatgaaccagacgtcgctggcctgcggagtcgaggcagtcaaggatgtccggtattttgaggaaggaatccaaaagatcattaagaccagggaatgggcaaaggaagaactggagaaacttggttttaagtgcctggaatctcaggcaaacttcatatttgccatgcatccggaatatgatgcaaaggaaatgtttgaagcattaaaagcgaacgatatctatgtccgctattggggaagcaaacggatcgagcagtatatgcggattacgataggaaccagggaagagatggaagccttgtttgcttttcttagaaaatatatgaacaaataaaggagaattctatgactgaaactttagtgcaaagcattatcgatgcccttagcggaagtgttggaaaggaagcgatcgtatttatcatatccatgataccgatcctggaacttcgaggcgccctgcttgtggcaggcccattgcttggcgtgccggtagcgacggcaattcctctatgtattatcggcaacattattccagtgccgtttatcctgctcttgatcactccgatctttaaatggatgaaggggacgaagaccttcaagccgatggtggataaactggaggcaaaggccatgagcaaaagcgataagatagagaaatacgagttctggggactggtgctgtttgttggaatcccactgcccgggacaggagcctggacaggatccctgatcgcagccctccttggcgtaaagtttaagaaggcattcccggcagttattttgggtatctgcatagcgactgtcattatgtggttcatatcctatgtaatccttggaggagtccaggtgatcgcatagaaactggaaatataaaagagaagcgttggcttctcttttgctatttggcgaataagccaggaacttagcaacgcgtctacgggcactttaaaaattattcatagtgtggtaaaatgtttaaaaatgtttggataaggagtattgggtatggaaaaattatatgatgtaactgcaatgggcgagatgttgattgactttacattgaatggacaaagcgagcaggggaataatctgtttgaggcttgtccgggaggcgcgccatgcaatgtactggcgatgctcaataaattaggacgtaagactgcctttatcggaaaggtgggagaggatcagttcggacgccttttaaaaggaacgattgatgaactgggaatagagacgaagggtctgattctggacaaggagatccatacgacgctggcatttgtacatactttcccggatggggacagggagttttctttctaccgcaagccaggggcagatatgatgctgacagaagacgaggtggattatgacttgatccgccagtccaggatcttccattttggaaccctttctatgacagacgagcctgtcagatccgcgacaaagaaagcgctggaggtagctaaagaagcaggctgcctgatcacctttgatccgaacttgcgccctccgctctggaattccctggacgaggccaagaagcagatggagtatggattccaatactgtgatatgctgaagatctccgataatgagatccagttcgtatcaggcaaggaagattacgatgaaggaatccgctatctccaggacaaatacaacattcccctgatcttcctgaccatgggaaaggatggaagccgtgcgtattacaaggatatgcgggtggagagaaagggattccaggtaaaggctattgagactacaggcgccggggatacgttctgcggctgctctatccacgggcttctgacccatgggctggaagggctcacagaagagaacttaggggatatgctgacttacgcgaacgcaggagcggcgctgatcaccatgaagaaaggcgcgatccgctctatgccggagccggaaaatattacgaaattaattgaggaaaaataaaaatatgagactacgcagaatgctggccatttgggcagccaagattaccgagaaaatcagcgtccatgtattccatcgccagggcgtgacatgggcgggaaagatcgctttaaagatatgtccaaccatactgaaagaactggcagggcaggtaaagaaggatatctttatcgtttgcggcaccaacggaaagacgaccaccaacaatatgctttgcgcggccttagaggctgagggataccgtgtcatctgcaaccacacaggctccaacatgctgaacggcgtggtggcggctttcgtgctgggagccgggaacggaggaagccttcatgcggactatgcctgcatcgaggtggacgaggcatccacaagaagggtttttccccactttaagccggattatatggtgctgaccaatctattcagagaccagctggaccggtatggggagattgatattactatgaatatcctgaaaggcgtcatgcaggatgctccggatatgaaggtgatcgtcaatggagacgacgccctgtccgcatatctggcgatagacagcggcaatccttatgtcacttatggcatcagcgagaaggtggttgaggatgaggattccagagagatccgggaagggcgtttctgcaagcgctgcggcgcgccgcttcagtatcgtttctaccattacagccagctgggcgattatgcctgcaccgggtgtgatttcaagcgtccgcagatagactttgacgctttggaagtagaagttggcagcaggttggcgtttacggtggaaggacaaaggatcgaggcgaattacaagggattctacaatgtctataacatactggcagcctatgcggcagccaggacatgcggccttgcgctggaacacttcaatgagatgctgttaagattcaatccagagaacggacgcatggagcagttccaggtaaaagaaacgaagatcctgctgaatcttgccaagaatccggcaggctttaaccagaacatatccgccgtgatgcaggatgatgctcccaaggatattattatcgtaatcaatgataacgcgcaggacggaaccgatatatcctggctgtgggatgtggactttgaccggtttaagaatgacagcataagttctatcacagtcagcggaatccggtgccaggacatgcggctgcgcatgaaatacgtcgacatcccgactgtgcttgaggcagacgtagaaaaggctgtccgcgggcgcatagaagatggatgcggcaacctgtatgttcttgtgaactataccgcgttatttagcacccggaatgtattaaagagattggagggggagaagtgatggatatggcagacatgaagataacgatcgggcatctctatcctgaccttctgaacctgtatggggatagaggtaatatcgcctgcatgatgaagcgctgccagtggcgggggatagaggcagagacgatcgaattcaacacaggcgacgagattgatttttccagactggacatcgtgctgcttggcggcggctcagacagggagcaggcgatcgtatgccagaatctcctgaggattcgggatcaatttcaggagtacgtagaagatgacggcgtggttattgccgtctgcggcggataccagctgctgggaagatactataagacggatgacggcatgattgaaggcctgaatctggtggatatctatacggagcaggaagaaggaagactgattgacaatatcgtgctccagagcgagttagcggatatgccggtcgttggttttgagaatcatggcggacgaacctacattaatgataataagccgtttggaaaagtattatatggttccggcaatgatgggaaaagcggatatgaaggagtggtatataagaatgtgataggtacttacctgcacggcccattgcttccaaaaaatccccagatctgtgattacctgattcagaaagcattggagagaaagtatgggccgatgacgcttttaccattggatgacagccaggagcaggaggctaacgagtatatataccgcagatttgtgaaagaatagatgagatattaggtggcttcttgttcccggtcacgtaattctagaagatgaatatattccagcagatctttctgggaacgggaagaaagcatcttatacttatacaggaggttctgttccatgggaggcagattttcattctgcgccaaagccatgtggatgacctcgtcatcttccaggagatagtcgattgttacgtggaagaggttggcaagggctgccagtttctcatgcgatggctgtcggttcttcgtctcatacccggctatcgttgaacgcgcgacgttcaagcggctagcaacatagtcttgcgtcatttcattttctagacgtaacatttttaactttttggaaaaagacatggccggcacctccttagttttttgtgttaattttatcaattgttgcagtaaagaacataaaaagtgccgaatatcaacaaagtgttgcgttaggttgcaaagtggaacaatgttgagcaaaagtaaagaaatagaaaggaataggcaataaatgaggcaggaaaggttcaaaatggagagagaaggcctggttgaagaaggacaggaagtagaaatcagcgagcggagtgccgttacaggacagtatacctatctggtggagccttcgattgccatgtccggaatataccggaccagccagagaatcaaatctcgcaaaggaaggatcagccggatcgagaagacagagaaaggattctacctgctggtagacatagatgagtaatgggaagtaccccgttgacaccagggggcaaagaacatataatttaaagtgaagcaaataatgtaagactcgaaaggaactggatagatgataatagcgaagaatgatgaagcgaaaagaagtaagatctggaggattgtcacacttgtctcatctgtcctgattatagttatagcgatttttcttctgacaaagctcttcacagctaatccgctggaaggaacatgggtggacgaagacagaagcctcaggctgtcaataaagagcaatggaacgatcgacgtgaatgttccggaggtggctgaagatatcagcgtgggcgtgaagctgaattatacgatggacaaagaagaaaagaccattacaattaaggcggatgagtcggaatttgagaagcttgcaaaaaagtctgacggcaagtatacgcaggaagacttgaagaatgccctggattccgtgactacgacatttgactacagtgtggatcaggagcaattgacactgacagaacgcgaatatggagaacagatgacctttataaaggaatagcaatgatatgcccctctatttgagacaccgatcagacaaggtgaccgatagaggggttcctgctgttcgcaggatactgtattatagaaaggataaagcaatgtttagagacaagacgaaaaaggtttggataggagaagtgtgtataggcggaggaagtccggttgccatccagtctatgacgaataccaggacagaggatgtggaggcgacggtggcccagattctggaactggaacgggcaggatgccagattattcgctgtgcggttccgacgatggaggcagcgcaggcgcttgcaaagatcaaggagaagattcatatcccgctggtggcggatattcattttgactatcgcctggcaattgcggcaattgagaatggcgcagacaagatcaggatcaaccctggaaatatcggggccagagaacgcgtgcaggcggtggtggataaggcaaaggaataccaggtgcctatccgcgtcggcgtaaacagcggctctcttgagaagcatctggtggaaaagtataaaggggtgacggcggaaggcctggttgagagcgctatggacaaagtgcacatgatagaagagatgggatatgacaatctggtggtaagcatcaagtcttccgatgtcatgatgtgcgtcaaagcccatgaattaattgcagacaggtgccagtatccgctgcatgtaggaatcacagagtcagggaccctgctggcaggcaacatcaagtcttccataggcctgggactgatactgaaccagggaatcggagataccatccgggtatccttaaccggagctccggttgaggagatcaagtccgccaaactgatactgaagacgctgggtcttagaaaaggcggcatcgaagtagtatcctgcccaacttgcggcaggactaagatcgacctgattggactggcaaatcaggtagagcagctggtggcggatattccgctggatatcaaagtagcggtaatgggctgcgttgtcaacgggccaggagaagccaaggaggcggatatcggtatagccggcggcataggagagggcctgctgatcaaaaagggacaggttgtaaagaaagtaaaagaggaccaattgttagaaacgttgagacaggagttgttgcactggaatgagtaagccgttctttgaagtattcccaacattaaaagtaaatgaagatatccgcatgctgtttgagggcgtggaggtaacgaaagttgccaccaattccgaccgggattttatcaaggtgcatctctacagccgtcatctgatccagaaaaggcgtatctacgaagtagagaagctgatgaaggatcagctgttcggacgcagccgcatccagatcgaagtgaaggaaaggtatgaactgtcagagcagtatacgccggaaaacctgatgaatgaatattttgacagtcttctgctggaactgaatgaaaaaagcgtggtggagcgcagcatgctccaaggctcaaggtatcaatttgaagaggggaatattctttgcctgacgcttacggacaccatagtagcccaagggaagaaagaatcattgtccggctatctggcagaagtatttcaggaaagattccagcggcccattgaagtacgggtcgcatacgagaagcccaaggatagcaagttaagatataatgatgtcaagcttaagcaggaagtagacgccatactggaacacgcggaagcggttcaggaggagaaggaacttaagaagaaggcccaggaagaaaaggaaggcgtttcttcaaagtccacgaagagccagaatgggaatggcgcgggcaagaaggaaaagaaggcgtttttcgggaatggcagaagagaaggattctcttataagaagaattccgatgatccgaacctgatctttggacgggactttgatgatgagacgatagaactaaaacaggtagttggcgagatgggcgagatcaccatccgcggcaaggtcatcagttttgatacccgggagatccgtaacgagaagacgatcatcatgtatgcggtgacagactttacagatacgatcatggtcaagatgtttgtgcgaaacgagcagcttccggatattctggcagacgtaaagaagggcgcattccttaagatcaagggagtcaccaccattgataaatttgacggcgagcttaccattgggtcgatcacaggaattcgaaagattaatgattttactgagtccaggaaggatacggctccggaaaagcgggtagagcttcattgccatacgaagatgagcgatatggatggcgtatcggaagtaaaggatcttgtaaaacgcgcccatgactggggacacaaggcgattgccatcactgaccacggagtagtccaggcattcccggacgccaaccattacatagagaccctggataaagacgatccttttaaggtgatctacggagtagaaggctatctggtcgatgaccttacggatgtggccgtgggcgaaaaggggcagacgctggacgatgtctatgtagtattcgatctggagacgacgggctttagcccgattaaggataagattatagagataggcgcggtgaaggtagagaacgggaagataacagagcggttcagcacattcgtaaatcccaagatcccaatcccgtttcgcatcacccagctgaccagcattacggatcagatggtcatggatgcgccggatatcgagacggtgctcccgcaatttctggaattcattggggatgcggtcctggtagcgcataatgcgtctttcgacgtgggatttatcgaacagaattgtagataccaggatattgtgccgaattttacttctgtggatacggtggccatggccagaatccttcttcctaccttgtcgaagtttaaactcaatgtagtagccaacgcactccatatatccctggagaaccatcaccgggcagtggacgacgcaggcgctaccgcggagatcttcgtgaagttcgtggagatgctgaaggaacgcaatatcaatgatctggcgaagttaaaccggtttggcagcaataatgcggatgcgatcaagaagcttcccacataccatgtgatcatactggctttgaatgaggtgggccgggtgaatctatataccctgatatccaagtcccatctggattactatgccaggcggcccagaatccccaaaagcgagctgtccaaatacagggaaggcctgatggtaggcagcgcctgcgaggcgggggaactgtatcaggctatcctgaatgagaagtcggaagaacggatcgcgaggatcgtcaatttctacgattatctggagatacagccattgggaaacaaccggttcatgattgccagcgaccgtattgagaatgtacagagtgaagaagatcttaagaagatcaacaagaagatcgtggatctgggagaccgattcaacaagccggttgttggcacctgcgatgtgcattttatggatccggaagatgaagtctaccggcgtatcatcatggcaggaaaaggattcggagatgcggatgagcaggcgcctctttatctgcgcaccaccgacgagatgttagaagagtttgaatatctgggttcggcaaaagcaaaggagatcgtgatagacaatccctgcaagattgcggatatggcagaaaagattacgccggtcaggccggacaagtgcccgcctgtcattcccgattccgataagacgctgagggagatctgctacaataaggctcactccatgtatggggaagaactgccgccgattgttacggagcgtctggagagggaactgaattccatcatttccaacggcttcgcggtgatgtacattatagcgcagaaactggtgtggaagtccaatgaggatggctatctggttggatcccgtggctccgtaggctcttccttcgtggcgacgatggcgggaattaccgaggtaaatcccctgagccctcattactactgcaagcattgccattacagcgacttcgagtctgaagaagtgcgggcatttgccggcggctgcggatgggatatgccggataagaactgcccggtctgcggggagaagctggttaaggacggattcgatattccgttcgagacgttccttggattcaaggggaacaaggaaccggatattgaccttaacttctctggcgactatcaaagtaacgcccacaagtatacggaggtcatcttcggcgctggccagacctaccgtgcgggcacggtaggaaccttggcagataagacggcgttcggttatgtgaagaattactatgaggagcggggacagcggaagagaaactgcgagattgaccggattgtccaggggtgtactggaatccgaaggagtaccggacagcatccgggaggcatcatcgtgcttcctctgggggaagagattaattcatttaccccggtacagcatccggccaatgatatgacgacagacatcgtcaccacccactttgactaccattccattgaccacaacctgctgaagcttgacatcctgggccatgatgatccgaccatgatcaagacgctggaagagtacattagttctccagcgctggaaaatgaatacaatgagacggacaaccgattcgtggcaaccaagattcccctggacgacaagggggtaatgtccttgtttcacgatacgtcagccctgggaatcaagccggacgatattggcggctgcccggtgggatgcctgggcatcccggaattcggaacagactttgtcgtacagatggtggttgacacccagccaaagactttgtctgacttgatccgtatctccggcctgtcccatggaacggacgtgtggcttaacaacgcccaggaattgatcaagagcggaaaggctaccatatcaacggcaatctgtacccgtgacgatatcatgacctacctgatcaataaagggatggacagtgaattatcctttaccattatggaaaaagtaagaaaaggcaaagggcttacagacgacttcgagaaatccatgaaggaggcaggagtccctgactggtatatctggtcctgcaagcagatcaagtatatgttcccgaaagcccatgcggcggcctacgttatgatggcgtaccggatcgcttactgcaagatcaattatccgctggcctattatggggcgtattttggaatccgcgcggacgcgttctcctatgagatcatgtgccgtggcaaggatgtgctgcagcattatatcgatgaatataacagccggtccgcgactctgagcaagaaagaacaggacacgatgaaggatatgaagattgttcaggagatgtatgccagagggtatgaatttatgcccatggacatctacaaggctcaggcgaccaagttcctgatcgttgacgggaaactgatgccgcccctttcaagcattgacggaatgggagagaaggcggcagaagcggtggcggaagcatccaaggacgggccatatctgtcaagggacgacttccggcagcgtaccaaagccagcaagtcggtcatcgactatatggtggaactgggcatactgtccgacctgccggaatccaatcagctgtcgctgtttgacttctagcgtgccggaaccagaagtgcctgtgacggcacgatggaagaaaaaataagaaatgagaggaaaaccagatgtggctactatatgctgttgggtcttcgttttttgcagggattaccgcgatccttgtgaaaatcggagtggaagatacggactcccacctgctgactgcgcttaggacgatcgtagtattaatattttcctggatcatggtatttgtcgttggatcccagggaaccatttcagaagtatcgccaaagacgctgctattcttgtgcgcgtccggaattaccaccggggcatcctggatctgctatttccacgcattgcagatcggagatgtcaataaggtggtgcccatcgacaagtccagcgtagttctgacgattcttctgggcgtcctgttcctgggagagccgatgagcgtgtcaaagggaatctgcgttatattgatcgccgcagggacctacctgatgatcgagaagaagcaggggacggaagaaggaaagaaaaagagcaaaagcgccattctatatgccctgctgtcggctgtctttgcgtcgctgacagcgctgcttagcaaaattggcattgtcgggatcgaatccaatcttggcacggccatccgtaccattatcgttctgatcatggcgtggctgatcgtgctggcgggaggaaagcagaagcagatccgggatgtgagcaggaaaagctggacctttatcatcctatccggaatcgctaccggcctgtcgtggctgtgctattaccgggcgctgcaggatgggccgatcagcgtagtgctgccgattgacaagttaagcatcctgatatccatcgcttttgcatatattatatttaaggaacggcttacgaggagatcaggcctgggacttgctatgatcgtaaccgggacgctggggatggtggtgctatgagtggcagcaggcgttataaaggaatcttgtacattgtcctgtccgcgttctgtttcgcgcttatgaacctattcgttcggctggcaggcgatttgccttcaattcagaaaagtttcttccgtaactttgttgcggcaatcttcgcatgcgtgatccttttaaaagaaagcgtgccgtttcggtgcaggaaggagaatctaaagtttatgcttctgcgttccgtctttgggacgcttggaattctttgcaatttctatgcagtggatcatctggtgcttgcagatgcgtccatgctaaataagatgtctcctttttttgcagtgctatttagtttcctgattttaaatgagaaggtgaaggttccccaggcattgatggtggcaggcgcatttgcaggaagcatgttcgttgtaaagccgacgcttacgaatatggatcttgtcccatccatgatcgggctactcggcggaattggcgcgggcgcggcttatacgatggtcagaaaactgggagagaatggggaaaaaggcccatttatcgtgttcttcttctcgacattctcatgcttattcaccttgccttggctgatctttgactatcatcctatgtccctgtcccagaccgctatcctcctaatggctggcattgcggcggcgggagggcagttcgccataaccgcggcctattgccacgcgccggcaagggagatatctgtctatgattattcgcagattatcttctcggctggattgggatttgtcatattcggacaggttccggatgcctttagctggcttggctatggaattatatgtacgatggcagtactgatgtttttatataacagaagaaaccaatagcctcttttctgtatacactataagtgagaacagaaatagaggctattattatgagattaagatgctgcaataagaatcaggaatgcatcgacttttttgcacaatatggaacaagttccaatccggcaagtggaagctttatcccacttaacgccatattccgcaggggggacgagattcatctggaagaggagacgcagatcgtactggcgcctggatatctctacctgattgattatgtattcctcgcaacgccggaggcagatggctttatggagatcataccatatatcaatggcacgccaaggcttctctattccttcttcgcgccaacgggggcggagaggaatacgtccgcttccgcaggatttacgacgaatgaggcggcaacaagcgaggcacggctatccttccgcctggattatccggctacgacaaggaatattgatatatcagggacagtttctgtcacgccgctgatgaagattggcgatgagcgaggcacgttttaggcaaggacgaagtgacggatgatgcaaaagtccgcgggatataatcagagctgccagaatcagaatgcatccaagaataatcttcatcgttaccgtctctttgaaaataagcacagaaaagagaaagccgaagacagactccagtgacagaatcaatgctgtgtggctgtctttggcatacttctgggcagcattctgcaggcagatggcaagggcggtattaataaagacaagatatgttacgccgtagagagagccccggttcgtgcatacgatctttgtgccagagaagatgacgcagattatggatagaagcccggaaaaggagaactgataaaaggtcagggcaatcggatccaaggacttggcatatctgccggttaagacaatctgaatagaaaacaccagggcaaataaaagcgtgacaggatcgcccatctgaatgccaagatctccgttcaggctgataagcgcgataccgaggatagcgataaatgcagccaggccatcctttttcagtggcctggcttttgtgatggcccatgccgcaagcggcgtaaagatgacataggtggctgcaagaaatgactgcttggcaggagtcgtgtactgaaggccaaacagctggatcagaagacccagaaattggaggacgccaagtaaaaggccatattttatgattcctctttcagccaggcggatcctcctgttaaatatcaggcccatgatgatcgctgctccacagaagcggtacataagaattgcaagagggccaagcccctttagcgcgtattttccggcaacaaatccgcctccccagattgcggcaacgataaaaagcgtcatatcagcaagtaagagcgtcgttttatttgatagagtcttcatagaatattcctcctttggaaattgagttgaatatatcataaacaaatgctaaaatcaatataactaatgaatttaaatatatctaaatagtgtttgctttttctaagaatattgataggaaaatcgaagatgacgaaaaaggagaacagcagatggaaaaaacatatcaaattggctccaggctgtcaggctaccggaaggcgcatgggctgacaataaaggaattggctgtaaaaacggggcttagtactgcgcttttaagcgaacttgagcgtgggattgggaaccccacgctctcggtactggagattctggctggtacgatggggatatcggtatccgcgctgctggagcaggaagttaagaatgcgtccctggtaagaagaaggtgcgagcggagccagacaggaggaccggacgcaagatgtctctatgatgttctggcagtcagtccggtaaagtccaggatggaactgcttcttctggaacttgagccggggatgtactccaatgatcggcttagcgtacatccttattgggaggagatcgcttatgtagtctccggtacggtacagatcttattcgaagaagaggagattgagcttagggaaggagataccatccgtatacttcccgggagaggccatcgtttgatgaatcagacagatgaaagggcgatggtactattcgcacaggaaagccggtagaattcatttgctaatatgagcggaaatacttgacacttaactatcttgtgatacaatatagttaggaacattgcaatgcaaggtagtgaaaggcgggatgacgatggatagatcacagctaatgaaaggcatattggaaggctgtatattgaagatcatcagccagtcagagacctacggctatgagattgtagaccggctgcaggagaatggattccgggaggtaaaggaaggaacgctgtatccgcttctcttacgcctggagaagaaaaagctgattcaggcaacctacaagccaagtcccttaggcccaagccgcaagtactattccctgactgaagaaggagaagaatacgtggcggcattctacggaaactggaaggaaatctgcgaatcggtaaagaagatatttgaggaggggttgatatgaagatcatggaaaacaagctgaaacagctggagaaggagaacgaagatgatttcttccgtatccggtcagaagaaagacgaaaagaagtatcccggatgatcaagtatatctcatcctcctcgctgcctctctaccagattcagattatccgaaaggatctgctggggatggcgcaggaggcggagcgccaggaactgccgctaaaggatatgctgggcgtagagccccgggaattctgcgatgagataatcgagaatgccgcaacgccagccaggaaggagcgggcctttcaggtggtgatagatgtcctgcagccttttgcaatctatttcacttttatgtggacttgcggcgggatgccttccagattcgggattacgctgacggatatcattgcattcctgggattgtgcggtatctgcagaggcttgatgcgctatatgggcaatcggctggcgatcaaaggcagtcctatcctgaatctgctgccctatctgttttttgcctgtatggtagcagcgatcgccatcggagggcgttccgttttaggctctgtgggaggaatgtatgtgatatcaggcccaggccttttcatggtcatcctggtggatgtgattgccataggagcgacgcttttatggaaccggtattggaataaattccctaagtagacagcatattccacaattttacaattctaaataaaaacacgacacaatgctgtcgtgtttttatgttatagtagtagcagataagtaacggggaggaagacgatgaagattgacagactgatcgggatattatcaatattgctgcagcaggagcgggtgacggctccttatcttgcagagcggttcgaggtctccaggcgtacgatcaacagagatatcgaagacttgtgcaaggccgggattccgctggtgaccgcgcagggcgcaaatggcggcatatcaatcatggaaggatacaggctgaatcggacccttcttacttcttcggatatgcaggcgatccttgccgggcttcgcagcctggacagcgtatccggtaccagcaggtatcagcagctgatggataagctggaggtgaatcatacgacgcttgcttccaacagccatattctgatcgacctgtcctcctactacaagtccaccctggcgccgaagatcgaattgatccaggatgccattgagggaagacattatatccagtttgactattatgcgccaggcggggagggcggtcggttgatcgagccttatcttttggtcttccagtgggcctcctggtatgtgtggggatggtgcacgaagcgggaagattaccggctgtttaagctaaaccgaatgctggaattaaaggtcgcaggagaacagtttgaaaaacgcgaccttcccaagtacgagccaagggtagaggcggcatatccttttgaaatctcggtgacggccgtgttcgagccggagatgaagtggaggctgatcgaagaatatggcgtggacagtttcagaatcagggaggatgggaaactgcagttccaattctattttcatgacaaggagaatctgtttagctggctgcttacattcggcgataaggtggaattattagagccggaaggccttcgggaggaaatccggctgctggcagaaaatatcggcaaaaagtataagaagaattagaaacatgacacataggtgtcgtgttaggcgtgatatgcttgtcataaataaagaaagcaagaggaaaacagcatggattatgatatagtggaattgaaagaaaagacggtagcagggcttgcagccagaaccaacaatctgtctcctgatatgggagcagtgattggagggctttggaaacggttttatggagaaggaatctatggacagttaaagcacaaggtcaatggcaaggcaatgggaatctactccgactatgccggggatgagaccggggattatacgattacggtcgcatgcgaggtagaagatgcagacgggctgcccgaaggcgtgacgtcgatgacgatcccgggaggcagatatgcccgattcgttgtctatggagatatgcaggcggctgtggcaagattctggcaggaactttgggagatggatcttgaccgggcctttacctatgattttgaagaataccaggatgacagtatggaggagacttgtatccatatgtatatcgcgctgaattagaggaggtagcgaagtatggcttccagcaaagagtttgttcattatgtagaagagcagttaacagatgcaggagagattacgtgccggaagatgttcggggaatatggaatctactgcaatggcaagattataggagtgatctgtgacgatcaattgttcctcaagattacggaagcaggaaggcgcatctgtccggatggagaggaagcgcccccatatgaaggcgctaagccatatctgctgatcgatgatattgatgaccgtgggtttatgacgaggctggtgcaggcagtctatgaagaattgccggagccgaagccgaaaaagaccaagagaaaagagggacaagaaaatggaaaaaatggattataagaaggcatataaggatctgtatatgcccaagaagaagccttccgccattcaagtgccaaagatgacgtttatcatggtggatggccgagggaatccgaatacatcaaaggattataaggacgccatggaaattctctatggcctgtcttttactattaagatgagtaagatgagcggccggcagccggaaggatacttcgagtatgtggttccgccgctggaaggcctgtggcgggcggatgactgtgcctttgacggcaggaatattacagataaggacaagtttaaatggacttctatgatccggcagccggagtttgtaacgacggaagtatttgagtgggccaaggcagaacttaagaagaaaaagccggagattgatttcgcaaggacccggcttgagacttgggaagaggggctgtgctgccagatcatgcatgtaggtccatatgataatgagccggcaacgatagcggttttggaagagtatatccaggcatccgggtatattacggatatttcagatcagagatggcaccatgagatctatctgggagaccccagaaggacgaagccggagaatctcaagacggtgatacgccaccccgtcagacaggaggcatagaatggaatttatcagggttacagaggaaaatctggaaaaggagcacatctgctgtgcgatttccagtaataaagactgccaggtagtttcaaaaaagcggtggctgtcaaaacgattccaggaaggactggtatttttaaaagcaaatgtgcggggaaaatgctttattgaatatctgccggcggaatatgcttttgcgcctgtgaaggccgatgggtatatgtatatcaactgtctctgggttgcgggacagtacaaaggccagggatattccagccagcttcttgaggcatgcatcgatgacagccggaaaaagggttgcaaagggctggcaatcctgtcagcggacaagaagaggccctacctggctgatcctaagtacctgcgttacaaaggatttcagacggcggatactgcggggccacattttgaacttatgtatcttccctttgcggaaggcgcggatgtgccacgattcagggaacaggtgaaaaatccacagatagacaaaaagggatttgtactttactatacagagcaatgcccatttaccgccaaatatgtaccgctgattgagaaaatggccgcagacaaggcaattccttttgagacgatactccttgagacggcagagcaggctcaggcagcgccggccgccgtcacatcctactgcctgttttatgacgggaaattcctgaccaatgagattctatcggaaaagaagtttgaaaagattgcctcagaagtatatgataaaatggtatgatgaaaggatggatagatcggaattgtccgctaggatagatggatgaaagatataaggaaggcctataggaatttatatggaggaatcaacgaatatgaaaatatatattgcgtttctgcgtggcatcaatataagtggtaaaaataaggttccaatggctgaattaaagaaagcctttgaagaacttaggtttggagcggttaagacatatctgaacagtggaaatgtgattttttcaagcgatgaagataatatagggagtcttacaagccggattgaagcaatgataaaagaacggtttagtctggatataccggttttcgtcatatcaaaagaagatcttgaagatattttgcagcatgcacctgactggtgggggaacgagaataaagaaatctatgataatttaatttttattatgcctcctgctacatttgccgaattatggggggagatcggagagcccagggagggcctggaaaagattaaggattataaggaaacggtattctggtctttcagccggaaggattatcaaaaaacaaactggtggccaaagaccgcaggcatgaacattagccaaaaactgacaatcagaacggcaaacaccgtcagaaagctagttggaatgtaattgccttacagattccgggggagcagggaataccttatgaaactatggtccctttcagcgaggcgatccagttctcaatggcttttgctaaaataaattgctgctgcagaacagccatgccggtttccggaatatccgggttattctccttttgacgcaggttctcttccaggtggccttttaggatctttatgttttgctcaatctctgtgatacatgattgctggaggtttgtcggaaggttgtccagattcacgatgacagcattaaaatctaaaaacatactgattggctttgcggatatttccagcatgagcctttcaaattcttgctccccggcttcggtcagggagtaaacgaccttctctggcatttttccctctttgacaagatctcctttaatgaatcccttttcctctaattggatggcttttttataaatggatggcgtgctgatcttcacccattttgaaatattgcggtattccactaatttttggatatcataggcgcccataggcgccttttttaatatgcctaatacgattaaatctatggttgccataacgttcctccttattgggaaaacactatatattacagtagtataaaatttataattgttgtaacgtatattatcctattatatatgccttgtcaagattgacactatgttttcttgacaactactataaattatagtagaataaagccgtagttaatactataaaatatagtactataaagtacaacaaaaggagaatttctaatgagtggaacaaacaaaaaaatggaactattagggagcgcgccaatccccaatgctcttatggctctgggcattcctattatgatcggtatgctgatcaatgccctttacaatctggtggacgcatatttcgtgggcgggttaggggagacccagatgggagcgatctctatcgtatttccgctgggccaggtcgttgtaggtctgggactgatgttcggaaacggcgcagcatcttacctgtccagactattaggccgtggcgataagggcactgcgaataaagtggctagcaccgccctgtatagcagcgtttttattggggcagtcatcattatcctggcggcaatttttctgaagccgattcttgccatgctgggtgccacagatacgattatgccttatgcgctggcatatgccaggatttatgtgatatcctcgatcttcaatgtattcaacgtaaccatgaataacatagtgacgagtgagggagccacaaaaacaaccatgtgcgccctgcttttgggagcggtactgaatattgggatggacccggttttcatctatacgcttgacatgggcgtggcaggggctgcaatcgctacggcgatttcacagtttgtttctacccttgtatatctgtcctatatgctgagaaaaaagagtgcctttacttttcgggtaagggagtttgccttgaacgggcagatgatgacagagatcttgaagattggcgttcctacgctgacgtttcagctgcttgccagcctttctatcgcattggtcaatcgggcagcaatggactatggagacgcagtgattgccggaatgggagcggttacgaggattacatctatgggaacgctggtggtattcggatttctcaaaggatttcagcctattgcaggattcagctatggggcgaagaagtttgaccgtctgcgggaagcgaccaaaacatcgatccggtggtcaacaattttctgcgtggctgtaggctctttgatggctttgctgtccacgcagattatttcacagtttacagatggaaacgcagaaatgatttccgtcggttcaaaatccttgatggcaaatggcctttccttcttcctattcgggttttatacggtgtattcttccctgttccttgctcttggcaaaggcacggcaggatttatcctcggagcctgcagacaggggatttgctttgtccctgccattttgatccttccgatggcatgcggtatcaacgggatactctacgcccagcccgccgcggatgtgctttcagcgatcatcaccgtatttatggcggcccatcttcacagggaactgcggacggcagagagagttcctcaaaattaaaaaaagcagcgtaacatacttttgtacattacgctgcttattacataacgaacgaagtttcccgctggcctggcactgttataaaactagagagggcgcggaatatacccttgcagccagttcggaatccagcatataaaggcttctggagtcatggccaaagaggttgaacttggtgatcagatcatccgcattcttctcttcctcaccctgttcctttacaaaccagtccaggaactgcatggttcggaaatccttctgcgcataggcagcgtcatagatggcgtgaatcaggctggtgacatactgctcatgttcaaggcccgcttttagaggatcttcaaatccggccagaacagcctcaggcttatcgatagattccagtgttaccttctccccgttattctgtaaatattgaatgaaaagcatggcatggtcgcgttcttcctgtgcctggatattataccagttcgcgaatccatccagcccttggtctttatagtaattggcgaaatccagatataggtaggcggaatagaattccttattaacctgcgtgtttaataattcagctacttttggatctaacatatccatttcctcctttttgtttaaggtctgcagaatttctgcaaatttattataacattttgacgggatggtggcaatgggaagtgccggaaggagtggaagtggattttcggattctgatgtgatacgatggatccagaaaaaggaaggaggaagaatcattgagaccatcgcagataacggactggtgccacgcgattatccgatcccaggctgcttacgggggattctatattgatgccacgatgggaaatggaaaggatacgctgatgctttgcacgctggccaaagagactggaagcgtgctggcttttgacatccaggatgcagcgcttgaagccacgcagaggctcctggaagaacagggatgccttgggcgtgccaaacttataagggacggacacgaacatatggacttgtatgcaggggagggcaccgcagatgtcatctgctttaatttcgggtatcttccaggcgggagccatcacatagccacccgggcctcaaccagcgtggaggcgatccaaaaaggattaaagattctgaaaaaaggaggcatgatgagcctgtgcatctacagcggaggggacacgggatttgaagaaaaggaggggatcctggactgcctcagagaactttcggcgcgggagtatacggtaatcgtaaatgcgtactacaaccgggcaaacaaccctccaatccctgcgtttatctttaagaattaacgctataagccggaagatttacgggaaggggtttgacatttctggaagattgaagtatgcttaaaaggtccaaagaatcatagatgaatatatccaggaaaggaaggcgagattatggacggtaattcggcgcgaagttgtagctttacaatgacaatcggatacgggaacaccataagcatgccttcttttaggatttactgtggggagaggaggactctccttcgataaatgccttttcaactgaaggtttgattttgcgtgctgccatatccggttggaaatggcagtatttttatgcccgaatgcgcgaaaataacatttcagacaggaggcagagacaatggcaaagagtattttattagaattattggaggcgaggaactacaaagaattaaagagactgatgggagagtataatccggtggatctggcagatcttttgatggaattaaacgaccgggatctggcaatcgtattccggatgattgagaaggataaggcagcagaagtattttcttatatggatgatgaccagaggcagacgcttcttgactgttttaccagccaggagatcaagcacatcctggattccatgtatacggacgacgcggtggatctgctggaagatatgccggccaatgtagtcaataagctgctggatcaggtgagcaaggatacgcgtgcggatatcaaccggcttttgaattacccggaggatagcgcgggaagcattatgacggtagagtatgtggatctgtccccggacatgacggtacggcaggccctgcataagatccgtaccatcggaatccacagcgagacggtgtatacttgctatgtgatcgtgcagaggaagctggttggcattattacggcacaggcactgatgaccaatgatgaggatgtacaggtgaaagatctgatggaagagaattttatctttatccgaaccactgacgacagggaagatgcagccaaactcttccgcagatatggactgatcgcaataccggtactggataaggaaggatttatcgtagggatcgtaacctttgatgacgccatcggggttctgacggaagagactaccgaggatatccacaaaatggcggccatcgcttccagcgaagagtcttatcttaagacatccgtattccagcatgcgaagaaccggattccgtggctgctgatcctgatgttctcggcgacgatcacaggagcgatcatcacgaagtatgagaatgcattccaggtggttccaatcctggtgtcctttattcccatgctgatggatacaggcggaaattgcggctcccagagttcaacgctggtgatccgggggctggcggtggatgaactgcatttttcagatttcttctccatcgtgtggaaggaattccgcgtatccctgatcgtaggaattgtgctggcagcggccaacggcgtaaggatctatctggtgcatggcggcgatgtgcagatggcgatggtggttgccgcttcgctgataggaacgatcgtggtggccaagatggtaggctgcatgctgccgatttttgcaaagcagctgcatcttgatccggcaatcatggcgtcgcccttgattacgacgatcgtagatacctgctccatcatgatatatttccgcatagcgacccttgtattccggctataggcggcgctagaaatttaagagataaaaaagggacaaggatccctcacaagaaagcagtagcattttgctgctgcttttttgtgtataaaaataattccgcataagaacatgctgaaggcatgcggcaaaggtccaatgatagcaaataacaacaaagaacaacaaacggcgtctgcagccaaaaaacaacaaatttgctgtattctaagatagaaagcagacatgattttgagaaaggagagggtggctgatgcagaaaacaacaggaaaatcaaagaaggaggtttctgttgtaccgaaaagaacggatacaaaaggcagtactgaaaatgaacggattttgttggagagtatagcggggatacgaaaagaactgcatatcacgcagaaggaactggcacatctatcaaataatacacagcaagagatatccaggctggaacagaaaaaacacagcccttccgtcagaactttatgcaggatactggatagcattgattatgaactgttactatccaaaaaagataagaagaatacaaaaaagagaaatggagaaagagtatgagaagaaaaatagcagccattatcagccttatactgacaatgaccatgttgctggggacaattgcatatgccaaggggacggatacggacaagaaaatcactgacaatgtaatcttggattttataggatttgatatgtctggctataaagcatatcagtctatagaaattccaaagggaacaccggagagtgatctgagccttccggatgttctgacggtaaggatagaagggcaggaagagaatgtagatatgcctgttacctgggagtgcacagatgatgggtttggagggggttcttatcaggcagggcatgaaaatgaagatgcggttttcacatttatgccaagatgggaagaaaactttgcgctgtctggcgaattacagcaaaagacagataatggcgagataaagcttccgtggatagaagtaaagtatcaaaagggggagaccaaagaagattcggaaaaagaaatggcaagcggcgaagaaaagcaggcaaagaatctggaaccggattcgtcttatcctcaaactgccacaaatactacgggaacattaaagtttcttacaggttcatctgctattagcagtgagaaagccttcgatatcagaggcctcaaagacggaagcgaagtaaaaaccacttacagtaattatggatatgaattatatctgacggtaggggatgtttcagcggatagaggaaatatggagctgatatcaagtttaaataacggtcaggtaaagacggtaaacggtatgcaggtgcagccattgattacctttacatccgatcaggcttatgtaaaggtgacctacaaggtttacaatcctgctgatactgcaaaagtgataggactgtgcggcggagccgatattatgatagggggagatgacagggcagccatcaatagcacgtcaacgggtattaccatggtggaaggcagcaaaaatggaagccagttcagcctctattccaaaaatacatttggcgtgacggcgttggataccttatggtttggagagtataatcaaaggcagtataattactggaacagccgggaagggggagatctgccccagggaacggacagtggaattgcattttcctggcagaaccgtgcattggcgcctcatgcctccacagaatttacgcttctctttggagtgggagagccggcagccccgccggagattgatatagctgcggatatagaattggcttatagtgcggcggacatcggggtaaaagcgaaagtaaaggatgcggataccaggacctataacgtgtattattcgctggatgatggacaggaaaccatattagatgcaacattaaaaacactggtggacgataactttaccgaagacccgggaacccataaagggactgaccctattgctgcagatggcaagcgccagggagtggccggtgagataccagttccagaagaatgggcagagaattccgtccacaaactacagatatgggtgaaaaatgataagtatgccatgtcagatgttaagaccgtttacataatgaaaaaggcagcagaaggcggaggagaaatcgttgaagcaaatgagtatagtctggcttttgacgcaaatggaggaagcggaactccgcctgcatcaatgaaggcatatgaggggacagatgtggtcctgccggtgacagcccttcaaaatgatggctatcttttcggcggatggacgccggacgatgggacaacgatttaccagcctggcgaatcctatacgatgccttcacaggataccaccttgaaggcattctggtatcagacgcttacgccgggggaagtcgctcctgtcaccgctgaatatgggacggagatagcaccggtagtcttaagcgcgacaggcggcaggggcaatctgacctatgctgttgctccagggacgccgcttccggcaggattagttctgactgaggaggggattcttagtggaacgcccaccgatattaccaatgggcaggtatttgtaaaagtaatcattagcgacgcaatgggggagactgcggaggctgatataccgatgacaattggtaaaagacaggtgactgtgagcggggcacagacaacggaaaaagaatatgacgcagatacattgatggatgtaggcgctcttgctctggataatgttctgccagcggattcaatttctgcagctgcgacagcagaatttacgactatagatgcggcagaaaataaagatattaccttatcaggcattacattaagcggtacaaatgcagagaaatacagttgcgaggagactgtagtaatcaaaggtaaaattattccccgtacgattacggtgaaagtaaaagacgacagcaagaaggcaggaacgcagaaaccagaaccggaacttatggaagtctacgacgggataagcgcattgcaggggacggatacattggaaatgctgggaactccccgctacgcctaccccgactttagggatgagactggttcttatagggtggtagtttccttcgacaatgcaaatagcaattataatattatttgccaggagggaacattatcggtaggccaggatgctcctgttgagactacaaattatcaggtatccggaacaccaggcaatgggggatggtatacgagtccgattatcattaagcctcttggggacacatatgacatgtttgcagacgggactgcttcgattgaagtgaataacaaaaaggaaagcatccagatccagttaaaaaacagccagacaggccagcttacttcccaaaagacggtggaatttaaaagtgatacagaagaaccagggcttggaaccgtttccgtccaagagaagaatagaggcattttaagtagaattggacggacgctgacatttggaaactttttcaaggaaaccgtacaggtcacgcttcctgtcaccgacaatttaagcggtgtagaaaaactggaatacagacttccgggagaagacgggtacacagctgtaacattagatcaaaccgtatccgatgaggcggtttttgacattcctcttggaacaaacggaataatcaatgtacgggcaacggatatggcaggaaatataaatcaggtatccaatcttgagaaagatggagcagatgtctggattgttgaaaatacagcccctgttatttcagaatttacagcggaagaagtttctaaaaacggatggtaccgtacggatgtgacattaacggcgtctgtaacagatgaagaaagcgggcttaatcaggtgtcatggactttaaatggtggagacagcaatgtacttcttggcaatccggaagaaatgatacaggaatatcagtttaaccagaccctgacagataacgggaagcagactgttaaggtaagcgcagaggacaatgcgacaaatcaaagcacagacaggagcattacggttcagattgataaagaaatccctaccttaagcagtgtagaaggaaatccggaaaactggcaggagaaagaagcagagatttcatttaaaatcaaagatgagatcagcgggctggacaaaacagaagatgtccaggtattgaaagatggaaacacgccaattgctgtcatagcatccggggacacctatactttcacaacaaaaggaaatgggaaatatacggtaaaggcaatggataaggcaggcaatgagatcgcagaaagcgactgcattatcgtaagccgcataaaggatccagagctaaagcctccgataaatgatgaaagtcaaaaaggacagaaaggcacggcagtaaaaacgggagatgcattatcagcaggaaagatacttttttatcttatccttgccatagctgcacttggatgcatagcaatgtgtatgatcgtgaaacaaaaatcagcacaggcaaaaagaaggcatagaagaaagcgcagataaactgaaggggatgtaatgaattttacatccccattcatgttgcagctattaaaatgtcatcaatccggcatcctattttccggaaaagtaatatgaaaggaagtatattctccgggcacagaatcggcagcaatggttccgccgtactcttccatgcagtttttcgtgaaatagagcccgagcccgcagagtccgttttgctttttggtactgaagcggtagctgaaaatctggtccagatgttccggaagaattccttccccgctgtccttgaaaataatatgtgccagatggtctttataaagggcgcttaatgtaatcgttccctcgaagggcgtatgttctgtagcgttgattacaagattttcaaatgcacggaagaggctttctttgtgccccagcacataaaaggaagtatccgggagaagaagctgataatgaattcctgcggcatccgcataaggacaggtttcttcataaacaatgtgaagaaatgcatttaagtcaaatacttcaggcgctgtattatgggtagtttccgtatgaaaaagctgcaggctctgaacattattctgaatctgcatggatttgcggtcaatgacatccagataatgctggagttccctgtctgagcgcatgggggaattgcgtatatagtcaatataagtattgattgctgccacgggagcctttaggtcatgagccacagcggacaggaattcttttcgctcatccatcatgcgtgtaagccatgcagttttacgttctacttcctccttaagatgttctgtcagatattcccgttccagcaggatgcggcggctgtagcgtaaaatcaaaacagtaaatagaagcaccataataaacccgcagtattctgtctgccatccaaagtgtagcggctcatatctgccggcagtcagataatcgatcagaatgccaaagccaaatactgcatttgcgctcagcatccagatatcatcctggttctgataagaaattatacaggcagccacaatgaggtaaaaacttagaaagattttaaatatggccatgacatccccgtaaatagagacaaaggatggcaggaacgggaaaagtacatagtgtgaaagcgggacaaataggagcatgccaatgcaaaatgcataggcagccaagtggataatgcgaggaaatacgtggctgcacaaacggtacgtcagaacagtcatacaagttaaaatcacgaaaaaggatccgtcttccatcacatatggaagaacgcccatattgattcccagccaatggatgagcggataggaaatatggactgcataactgatgcagagaattccataagcaatatataaagccccggccttcctgcgaaaccagatgctgattgaaataacagcacatccaagcgtgaagaaacataagaaggcataaaaaataaggcggcagtttaccagatggagaatatcggaggatgttcccagaaccggcgggtaaatcatgccgctataataatgagaataatttgccgtatcgatgagaagttctacatagccggacggaagggaaagcagggcatttctgatatgaatctcatagtcttttctggagaggtttccataagaatgaatcaattctccattgacatagaccttgcatgcagaaaaaatctcaggaagttctaagagccatccgtctgcatttgcttccaaatgcagctgctttcgatacagaccgcggccaaagggagacttgtctttatgaaaagaagaaaaattacccgattcgccaatcgttatattagccggattggaggtaggatttccgctttcgtaatctgaataggaagtatcaggatagaattcccagtcatctgccaggacatagaaggattcatcgttatccagatatttattatccttcatataagttagataaaaaatcagtccgattccggccagggagagaattagaatcagagccggccgaaaaaggctgtacaattgtttttttcgctccatcatgattctgtatacacatacccctttccccactgtgtgcggatgtattctttatctggcgcggcggcctggatttttttgcggattcgtaaaataaggacctgtatgctgtgggtattgtagttttcaccccacaatgcctgatatatttcttcctgtctgtaagggattcccttgtgctggcttaaaaaatatagaatctggaattcatttgccgtaagcttaagagactgggtgccaatataagcctgctgttcttccggatacagagaaagagcagggggagcaggatgtttttgttcatatgaggagggaatatgcgggctgattcttgcacggatccgcatttcaagttcctgtaagcggtagggcttttctacatagtcatccgcgccgctgttgaatccttttacaagagactcgctgtcagtaagaactgtaaggaaaatgacaggcgtattggtagttttacgcaggttattgcataattcgaaaccatcctgcgcttccattttaatatctagaaccagacagtcataagacctgtcttttaacagttccatcgcttcttccgcgctggaagctgtatctacatcatatccgtgttctgtaaaataggaccggtttaaagaaagtatttctatatcatcatctacaaatagaagtcgctccataatgcacctgctttcattagtatcattctggattatattctatatggaatacaggcgctttgtaaatagatttcaatagaaagagaaactgttgttaatcattgtgaattcatgataagataaagcaaattacaaattgaggataaaaatatggaaaaaagatacaaatttcagattatacctgtttgtataatcctcttttttctcctgccgtttacagggaaggcgtggggacctccagccttggagaaagaggaagattttttaaagtggtatgaagaaaataaagataaaaacggcgcagtatattctttgtcgggggatttaaaactggaaagcggagacaaagaacatccgattcgacttgatggaaccgggaatgtcgtgatcgatgccggaagatatggaatcttagtggattgcgacgttcggattgataatccgaacctctgcatccggggaaataattttttctgcatcatggttcgaaatcatgcagacctggccctgaaccaggggaagcttatttatacaggagaagatggcgtggcgattcatgtcgcagaaggcaccatgacatcgccaggcgtgcctgatggatttgcaattcaggcacagggcaggaatgtaattggaatccagtatgatgggagccatgaaaaaagcgtatcgaatctgcatattgaactggatggaagccagtcatccaaaggaattgcaaccatgtcaaatgggtacatacccattatccactgcaatattcaggtcacaagccagcagtcggcgtatggcgtatatggagagggggccgcagattttctgattcaggaatcttttatatctgccagatggacggattccggatggaatcccgtgggggaattgtgcagcgtatactctgcacaaggaacggttgtaaatgataattcaaagttagaacccaaactggataacacaaagaactataccatgatggaaataaaggatccaagaccagtgtatgtagagacaggatcatccccggatcagtggggatttccggaaagcctggaagtatatgtatgggagatgggaccagaaaccgaaagaaaggtgtccataccagtcacatggaatgtgaatgagaacgcatttgggaagccaggttttgtgaaagtgcaggggaattttgaaacgaatgatacagagaatgtatataagaatccaaataatctcgtgcccgaaattaccgtattatgcctgccgccggaaaaaatgtttctggttggatatagcatttttaaagatgctaaggaaggagcgcagcttgtacttccatatccatatgatgcacagcggatggaagtaatgtacagcatggatgggaaagacttttcttattatctgtttgacgggcagaccaatgtcttagaaggtatggaagagagcaaggatggaatgttttctttttatctcaatcttccggtgaaagggaaagtgatttatttaaagacattggtgtatggagaaagtgtttttaaaggcgagagtgctgtgtggatgattgatgggagagtaaaacaggaacttccggacgggacagatagttcgaatggcggcgacagaggcggacagacattggagacagccatccctgccggagaagatggagaagaagatttatctaagaggaatgcagacggaggacagatcacagtcataacaaaggccggggcaggccaggagacgccagagaatgaagcggcagaatcaggaaaaaataaagatagagaatcaaagaaaattggtaaggacgtagaaaaaaagacaggggcagattcccaaagcgtgtctaatggaaacggggaagctgcttttgcaggtgctaaagttataatctcattgattgctgcattaggcttggcggcagccggaataggagtcgggagaaaaatctttaagaaaagataaggaaaaacaagcataacccgcagaaaatcgtgttctaaaaagcacgattttctgcgggttatgctttgcaggatgccttttgtggagacgattaaatcccctgtgccagccggtagatttctgctatctgctcccggttaagttcccgcacttttccgatcgtacgggtattgccaaaactgcatttgtcggcgagttccagaatctgctcttcgcttggggcaattccaagttcgtggaggctggtgggcattccaatgcttcgaaaatagtcttccatagcctgaatgcccagaagggccgtctgctccaagtcttcactgtgcggaacgaaaaggacattctcggcaaacttggcaaaccggtccaggcgatccttgcatacatagcgggcccaggtaccccatacggcagcaaggcctgcgccgtgagcgacgtcgaacatgccgccaagttcatgttccaactggtgggaagcccagtccccgccatcggtaccgcatccagtaaggccattatgagagaggctggaagcccacatgacttctgcacgggcgtcataattttgaggatcctttttcagaatcagagaattcttcatgacagtgcgaagcagtgcctcgctgattccgtccgtcatctccatattcgtgctctggttgaagtatcgttccatcgtatgcatcagaatatccacgcacccgctctgcgtctgataatctggaagcgtatatgtaagttccggattcaggatggcaaacctgcagcggcaatattcgcttttatagccacgcttctttaagccgtcttcgttcgtaatgacggaagagttgctcatctcgcttccggcagccgcgatggtaaggatggcgccaatgggcaggcaggcggaagcggtacgctttctcgcataaaagtcccagacatctccctcattggccacgccatagccgattgccttggaggaatcgataacgcttccgccgcctactgccaggataaagtcgactccttcccgccggcacagtgcgattccctcgcgtactttggagagacgggggtttggaaccacgcctcccaaagaaacataggggatgccttcggcatcgagggaagcatatacgcggtcgagaaggccgcttcttacgacgctgccgcttccgtaatgaaccaggaccttcctgcatccctgctctttgatgaggcttccggttttggactcggccgctttgccaaagacgactttggtaggcgtatgatattcaaaatttaacatattagacactccttctcactcattttttcatgaccattctatcatatttagcaataacagggtatggtataataatatatcaaaaaaaattatcgaaaaaattgtcacaaataagaaaacaagccgtctaattatatggaggtgcaaaatgaatcgagaaaataatgaaataatggaactggtggaccatgcagtgaatggggataagacatccttggagatgctggcagccggcgtgcaggacatggtattcaatctggcacttcgcatgcttggcaccgtgccggacgcggaagatgcgacgcaggagatattgatacgcgtgatatccaatctctcatctttccgcaaagagagtgcctttcagacttgggtctacaggctggccgttaactacctgctggattataaaaagtccatgttcgcaaaatatccgctggatttcgagttctatggaaatgatatccgctatgccaagacggatgagattgaagatctggttgacgaattaagcagggaggcctttgcggaagagttaaagatgtcctgtaccaatgtgatgctgcaatgcctggatgcccagagcagatgcatcttcatcctgggaaccatgttccggattgacagcaggacaggagccgagatcttaaatatgacgccagaaaactaccgccagaaactctcccgggcaagaaagaagatggcagatttcctggcagaatattgcggccttaccggaactggcaactgcagctgcaacaggcgggtggattatgcaatcgcgcagcgccgtatcaatccggccaaattagaatttgggtcattggaagaactggacgggcagcttatcggcgaatgtaaggaagagatggagaaactggatgaattagcaatgacatttgaacgttttcctcactatcggtctccggtatctgcccggaaactaattgaaaacatcctgaattcttcccccttcaggaagattcagcaatattaggagggttatatgagtgaaaagatcatgccatatttgacagaactaaaagagaataacagccgggaatggtaccatgcccataagtcgcagtaccaggaggcgaaccaggagtttgaagaactgatccaggaattgatactggaaataggaaaagtggatggcagcatcctgcacaacaagcctggggacttaacgttcaaactggtgcgggataccaggttcagccatggcaagtctccttataatccggctttccggtgccatatctcatccgccgggaaattgccaataccagtcgggtacttcctgtttcttgccccaggtggcgattcattcctagggggaggcctgttcgcggatatgttcaaggacgcgaccaggcgcgtacgggactatattgacggtcatggagaagaattcctggaaataattgagaaggaagcatttaaaaagcattttgaaatcagaggatcagcattaaaaaatatacccaagggatattcccaggatagcccggcggctgatctcctcagatataaaaactggtatatagaatcccgctttccagacgatcttctgaacgacacggatacattcgtccaatatgcagcagaaaaattcctgctgatgaagccttttaatgatttcctgaatcgggcgcttgagggattcgttatgcccagccgttagaaaaaaggggattgaccaaatcgaaattagacggtatactggtaccatcaaagacaaggacgtcgtatcgtggatacggcgtccttttttaattttaacaggcgtttattggtctagcttgagttccagggcatagacgatcccagataatgtatccatgccggaagaatgtccgatctcagaaaaagattttaaaatatctccggacggtggcagcaaggtcagcgagatcacggcgcggctgaaatgggatgctaaggcacaatcaaggaaggccctgctgatctcgtttgtattggcaagccgtgcgcgtatctggcatccaagttccagagtgaaaggatgcgagccctgatttcggaggaggaggccagccaatacgccgcacaggaaatcatcgccgctgggggtaaggccgatcccaagtccaagaagtccggctaatgtgctggcagccttctcatactgtccctccttaagaaggagcatgcaggacgacatccgcttcctggcagtttcaaggatgagatcaaaaggttctgccgaacccttataggagtcggacagcaggcaaaagcctccgacgtccgaggcggacaggacgctatgcagcctctcgcaaagtcgcgcgtgggaaaagcctgggggcaaagaggccagtcgcgattcgtagatctcttccggctgatatagaaaggaagacgaacatccggcagacgcagagtcaggcataacgatctctatccgatcgcccaggacattcacaggctggccggggcggataggaagctgatccatggatcgcccctccatatccgtgatcaggctgatgggagacagaggggacgcggctgactgcagtgccagcagatgctgtcctaattgaatgttgattgttttcttataaacagagtggacggttccagatatgcacaggcctaatatatggctggcataagcggctgtcgcagtaattacatggtacatggtataaatactcctttgtctacagattctaacagataatagaataaattacaaaaaaaaatgaaaaactaatttttttttatacataacagacaaaaatgacgtattttttttcgctttcatgtaattgtttttcaatattgtatctaataaaatacacttatgtattatgaatggttaaccaaagaatgacaaaaaaaagacaaggcgccttttgtaaggaggaaaacaatgtatgatttagtagtaaaaaatggtaagctcgtaactcccgaccgcgtttatgaagccgatattgcagtaaaagacggagtctattctgcatttttggcaaaagggtcagaggctgcagcaaaagaagtaattgatgcaaaaggatgctatgtatttccgggcattattgactgccatgcacatttgaatgagccaggatttgaataccgggaagactttgagacaggatccagagcggcagttgtggcgggctgtacttgcctgatcgatatgccattgaacaatgacccatccttaatgaataaggagatcttcgatctgaagatgggacgcattagcaagcattcggctgttgactttgctttatggggcggtattgtcggagattatgacagtcagccgggatcggtaaagaataatatggatgatcttgtggacctgcatcactgcggcgtagcggcattcaaaggatttacctgcccgaacggcgatctgttccccactgtcaacatgggaaatgtaagaaaggcattggagatactcaagccatataatgcgctttgcggcttccactgtgaggaattcggacaggtgctggagcgggagaaagaggcaaaggcaaaagaaggaagaaccagcgacgagaagatcagagactttctggattctcatgatgtatggacggagtatgtggcaaccaaaaatgtcattgacatggcaagggccacaggcggaagggtccatatctgccatgtaagccatccgatggtggcccaggtagtgaaagacgccatccatgaaggacttaagattaccgcggagacctgtccgcactatcttggatttacagaggattttgtatttgagaagggcgctccggccaaatgtacgccgccaatgcggacaaaagaagacatggagaaattatgggattatgtgctggatggaaccttatcctgcgttggaagcgatcattctccggcagcagatgaagagaaggataatgccacaaaagacatctggcatgcgtggggcggactgaattctatccagttcttcctcccaatgatgtttgacatggtagtgaacaagaagggattaagccctacgctgattgcaaaagttatggactataatcctgccaaagtattcgggctgtatggtcaaaaaggcgcgtttgaacttggatttgacggggatatcgtaattgttgaccccgaaaaggaatgggaatgcaggcaggaggagctgctgaccaaaggtcatgtgtcctgcttcgacggactgcaaggaaagggaacgccaatatgcaccattatccgaggcaaggtggttgctgctgatggggcttataaggaggatgcgatcggctacggtaaatatgtgacgcctgtgaaagcagactaatcagcataggaattaaggagagagaatatgagtgatgtgaataatgaagtaaaacagggagccgattctttagcgccaattaaggataaagaccggattatggggtggggctcttacttgatgctctggcttgggggatgtatttcaatcggaacgctgaccatgggttcagcccagctggataagggattgaatctgatgcaggtgttcctcgccgtgctgattggttccacgatcttggttatcggcatctgcgccaatgaccgattcagttataagtcaggggctccgtacgcgattcagttaaaaagcgcgtatgggacgaaaggaaatgtcgtgccggttatgatcagggggctgcctgccattgtttggtatggttttcagacatggcttggaggttctgcgattaaccagatatcgattgctatatttgggtatgataatgttgtattattcttcattctgttccaggtgcttcagatcatcctttccgtgaaaggattccagggcatcaaatgggtggaaaatgtaggcggcgtggtaatcgtctgcgcgatgctgtatatgctctttgtatgcgtcacccagtatggggatgttatcggggataagctgatcagtaaggaaggaacatggggaatgccttttattgcggcaatcatagccttctttggaaatagtacgacggtcatgctgaatgccggcgactattcccgggaattaaaatctggattttccgttggaaagcgtggtgttgcatactttatcgctatggtgcctacaactgtactgctggggctgattggagccatggcttctactgcgacaggtattgccaacccaatcaatgcgttttcccagatggtacataataaggttctgctgatcgcaacgcttggattcattctttttgcccagatgaccacgaaccttgcgagcaatgtggtgccgccggcatacgcatttatggacgctttcaagatgaagcacaggacggcagtaatcctggtagggatcctggcagtatgcacctgtccatggatcctgacgaatgacagttctgccgctgggctggatatgtttgtaaagatctatacggccttcttcggaccgatctttgcggtattgatcaccgattactatatcctgcatagaggaaaggtggaaggcgagaaactcgacgacctatacgatgataaaggaaatcatgcaggcattaactgggcggccattatcgcaaccgtgattggcgctgtcatcggactgattaatgtagacatttccttcttcacagcaacaatcccgacagggctggtatactatttctgcatgaaaaagatgccgtcctgcgaaagattcaggaaagggacttctttagagaagtaacaggaggcacgacttatgtatgatgttttagtaaaaaatgggaaaatcgtaacggcagatgccgtatttgatggaaatatagcagtaaaaaatggaaagatcgccgcccttatgtcagcaggcgaagagccggaagcagcgaaggtcatcgatgcaaaggggaactatgtgttccccggagcgatcgatacgcatgcgcatctgaatgatccggggtatgagtggagagaagattacgaacatggaacagcggctgccgctctgggcggatatacgaccgtgatcgacatgccgcttcagaatgagcctgccatgaccaatgcggatttatttgacaagaaagtcgagaaagtagacagcaacgcttatgcggactactgtttctggggcgggctgataccggataattttgaggacttaaaggggatgcatgacaaaggatgcgtggcgttcaaatcatttatcggaccagtatctccggactatagttctcttaactacgggcaggcatatgaagcaatgcagcgcatcaaagaattcggcggacgcgcagggttccactgcgaggacttctctatgatcaagtggcaggaagcccgcatgaaaaaagaaggccgcctggactggcagggatttctggattccaggccggtgatcgcagaaatggttgctaccgtggatatgatcgagattgccaaggctactggatgcaaagtccatatctgccatgtcagcagcccggatgtggctcagaagattaaagaggcccagcaggaaggctatgatataacggcagagacttgttcccattacttaagcctgacggataaagatgtaattgcaaatggcccgatgttcaagtgcgcgccgccgcttcgctctcaggaagaagtggaccgcctctggtcttatgtggaggacggaactttcagtggaatcgcaagcgaccactccccttgttcttatgatgagaaattcaaggaaattcttggaagcaagattgagaacgtgttcgacgtatggggtggaatcagcggaatccagagcggcttccaagttgccttcaacgaaggctgcacaaagcgcggcgtgaatccaagcgtactcgccaacgcaatggcagtacagccggcaaaggcatttggcatctatgggaggaaaggcgatattaagcctggatttgatgcggatctcgtgattgttgatccgcagaaagagtgggagatcaccagcgaatcgcttctatatgtgaataagatttccgcattcgtgggaatgaaagggaaaggacttcctgtgtgcaccatcatccgcggaaatgtagtagcagaagacggcaagattacggcagaaaaaggcgtaggaaccctgatcagaagattgggctagcctaccggcagatcgaaaggagagagaatgagcaatattatagaaaatatggatttgaatccggaactggttcagaatgtagacccggaccttcagcccacaaaaaagaggatcatgggatcattgtcctatacggcaagttttatgggagggtgcgtatcgatcggtacattctctatgggcgcgggcctgatcggggtattgacggtaggccaggcgattcttgccatggtgatcggatgtcttgtgattgctatagcgctggtagtgatcggaaactgcgggcataagtatggaattccttataccatacagcttaggagcagttttggcacggcaggcgtcaaggttccaggactcttaagaggcgtgccagcaattatctggttcggtttccagagctgggttggcgcgggagccatcaacagctgctttaagatattattcggatttgataaccttccggttatctacgcattatttaccatcctgcaggttgccctcgcgatcaaaggatttgaaggcattaagtggctggagaacatctcctgtatcttcatcatcgcgattctggcctatatgctgtatgtagtcaagacacaatttgcgacagagatcgatgatgtgttctcgggaatcaaaggaacatggggaatgcctttctgggcagcgactacatccttcctggggatctattcaaccatgatcatcaacgcatccgattattcccggaacgttaaggaaaaaatcggacctgtctttacaggcagcatttacaccgttgcgattctgcctgtgacattattcatggggctgatcggacttctggttacggcagcgacaggaaacagcgatccggtagtcgtattctccacaaccatgggaagcaagttccttacagtcgtaacgcttttgttcatcgcatttgcacaggtaacgacgaacgtgctgaacaatatcgttcccccgtcctatgtacttatggaatctttccacatgaaatggtcccatgcgaccatcgtggtaggcatcctctctgcatgctgcatgccctggaaactggttacagaccagtccgcagcaggactgaacttattcacccagttctattccgctttccttggcccaatcttcgcggttatggcggtagattactatatcctgcgcaagaagaaactggatatcaacaacatgtataataagcagggcgtattcaagggcgtcaactgggcggcgatcatcgccatcatcgtcggctccctgtgctcgctaatcatcgtacagctgtcatggtacgtaagcctgatcccgacgggactggtgtactacttcttgatgaagacaatgaaaagcgccaagccattcaggaccgggacaatatttgacacgtaacatttttcagatggacacgtaacacttttcaaaaatgttacgtgtccatcttacataactggtggaaaaaattgaaaaatgtccgtgccaaatttacaaaactggcgcggaaaattaaaatcattataaaaagcagagtttacggagggaacattactgaaaagccctgataaactctgctttttataaaaggtataacggaactatcaatttggtaacggataaattttaatttgacacaccagttgtatcgtttttgagcaccagttgtgtaggagtaacacgtgacacttttcaaaaatgttacgtgtccatctgaaaaatgttacgtgttaagttgaagaaactccagggactccaaaagtagtttttttgtaaagggattctcttcgtcccggtcaaagtcgtggacattcccgggggcaatgaactggcggggctggtagcggcttgacagttccaggaattccgcgtaaggcacgtccgggtcattggtgctgtgggcgcagaacaacgggcagggcagagatgggcaggcgcgaagcgtatagtccaagtagaagtatttttcccgtccctcatagagcaaagagcgccaggagccggtctgccttgcatagacatagacgctgtagtgcgtatccaaagcgccttgcgcgtgcaggtccgtgcccgcgtgatccaggcaggaagcatcgaccgcgggtagcgagcgatagtagtcgcttggcgtctgaaaccagttgtcgcacaagaatccatatccataataagaaaggattcctctaggcgcggtgggaagatctccctgggcggccgccaggaggcagagatacgcgccggcagagcgtccccacaggaagaaaggcaggtctaagccgcagtaagcctccgggtgctccacatagtgggcgatggaagagcagacgtcgtccagtatcacatccagctttgcggcaggcgcaagcggatagtcatacgagataatgacatagcccgccttggtcagcaggtccgtatgtaaggcgggaagatcgtcccgccttccgtagagaagcccgcctccatggaaataaagaatacaggcttttggcgtcacgccactgtctgaatagatggtggcgtattttagataagcagtgcttggaagttcgaattcccttgtctccttcataatataagtctcctttgaaaatagaataaattatggaaaaatacatagaatcttttttaataatccgaatgaccggatgatgggaaaatcatccgccaactaaagatattatagcatagaactgtaaaaagcgtacatgttaaaaacttgacaatagggtataaagtagataaaaacaaattctggttttgtctaaaaatataattgaaaaacggagggcatattggcataattagggtataaaaactggttgaccacaaaaagaatgaaagagaggattttaaaatgagttatttgaataatcaggtaggatatcgagaggatttattgacaacacgctccgtaatcaagaaggacaattatgttatccttgagccagacggactggtaaagaatgcaattccaggctatgagaactgcgatgtaacgatccttggctctccggctatgggagcatcttttgcagattatctggtaacggcaagagacggcggaaaaaatgatggaattggcggagaagggcttgagacattcttatatgtgatctctggagaagtgacggtaaagaatgcggacaaggaagaagttcttacagagggcggatacatcttctctcctgagagcaacaaggtttctttcgcaaacaacagcggaaaagaagcaaaactgtatgtttacaagcgcagatatgagagaatcgaaggatacagcgcatatacggtagtaggaaacgccaatgaccttccatgggtagagtacgaaggaatggaaaactgccacattaaggatttccttccggcagcaggagactttggatttgatatgaacatgcacatcctgaagttcaaattaggcgcatctcatggctacatcgagacgcacgttcaggagcacggcatgtatttcctgtctggaaaaggaatgtaccgcgttgatgacgagtggattccggtaaaggctggagactacatgttcctggatgcatattgcccgcaggcatgctatgcagtaggccgcgaagaagatttcgcatacatttactccaaagactgcaacagagacgtgcagctgtaaaatgtaaaacaagaaaaaagaataattgatataaaagatatagaagaggtgttagaatgaaactttcccgcgatgaattaaagggattaatgaaaaataaattgatgaaggccggacttagcgcagaacatgcggacatgaccgcggagattcttacatggtcagatgaaagaggttaccactcccatggggcagtgcgcgtggaatattacagcgaaagaattgccaagggcggaatcacggtagatccgaagttcgagtggaaagagacgggtccatgctctgcaatcttcgagggagacaatggctgcggatatgtagccgcaactctggctatggaaaaggcgatcgagatggcaaagaagacgggaatcgctgtggtaggcatgcgtaatatctctcacagcggctctatcggatattatacagagatggctgccaagcaggatctcgtagcaatctctttctgccagtccgacccgatggcagtgccctatggcggaaccgagccttactatggaaccaacccgatctcatttgcggccccgactgcggatgacaggacggtggtattcgatatggctaccacagtccaggcatggggcaagattctggataaacggtccaggcatgaatctattccggattcctgggctgtagatgaaaaagggcagccggtaacagacccaagccttgtaaacgccctggttccgattgcaggagcaaagggatacggccttatgatgatggtggacatcttcgcaggcattctgctgggagttccatttggcaagcatgtaagttctatgtatcatgacttgtctgaaggaagaaatctcggacagatgcatatcgtaatggatccttccagatttgtcggactggatgcatttaagaaatccatgtcccagtctctggatgaattgggagaaatgccggcagcagaaggatttggcaaggtaagctatccgggcgagcgcgcggtgatgagacgcgacaaggcctatgcgacaggcggcgtagagattgtggatgaaatctacgactatctggtaagcgatacgattcattttgacagatatgaccataagaatagatttgccgaatagaggaaggagaacgtatgttaaagacgattgtgaaaaaaggaagctatcatgactctgtcgtcctcatgcttttgacgaatcagatttccacgattgaaggcgtgaagaaggtttcaatcatgatggctacccctgccaataaagatatatacagacagagcggattaagcaccgaggaacttgaaggtgcgtctgccaacgacatggtcgttgtggcagatgtggatgacgagggcattctggatgtgatcatgcaggaagtggaagaattcttcaagaagcagtccacatccgaatctgaaaagaagggcgcggaatccgtaaagtcttgggataaggcgcttaaaaaactgccggatgcgaatcttgcagtcatctctatcccgggcgcgtatgcggcgttagaagcagaccgcgcgctggacgagggcatgaatgtattcatgttcagcgacaatgtaactttggaagacgagatcaagatcaagcagaaagcgcatgaaaagggactggcagtcatgggaccagactgcggaaccggaattatccagggagtgccgatcgcatttactaataacgtgactcccggctccattggaatcatcggggcatcgggtaccggaatccaggaattgaccaccatcattgaccgtcttggggaaggcgttaagaatgccattggaaccggcggacgcgacctgtctacagaggtaggcggaatcacgatgatggatatgatcgaggccatggaaagcgatgacagcgtgaaagtgctgattatcatatccaagccgccggcaaaagaggtaagagacagaatctccgaccgcttaagcaattttaagaagccggtagtcaccctgttcttaggcgagaagccagaataccatgaggagaacttctaccatgcctatacgctggatgaggcagcgcgccttgcagtagggctggtaagaggcgaggagatcaaagaaggaactgtagatgtagacgcatctaagtttttcggggcagaggaaaagaagacgatcaaggcatactactccggcggaacgctggcaggagaagcggcgatgctgattaaagacgccctgaatctgaaggtgcctccgcagaaggcagaaggattcatgctcaagacggatggccatatcgtggttgaccttggagacgacgtatatacgcagggaaagccgcacccaatgatcgatcctgcaaaacgtattgaatgcatgcaggatgccatcgacgatgaatctacaggcgtgatcctattggatatcatgctgggctatggctcccacgcagatatggcaggagcgctgcttccttccatcatcgaactgagagacaaggcacaggcagaaggaagaaaattattcttcgtcgctaccgtatgcggcacgagaagagatttccagaactatgacgaggcggttggaaagttgaaagaagcaggcgtcatcgtctgcgagaataataaattggcagtccacacggcaatccgcgccatcggccttgattttgaagagccggcaaaggacatccgtccaaagacggttgcaaaaattgagaagacagaagcgtctgagaagctgatcgcgcttctttccgagaagccaaaggtgatcaacatcggccttaagagttttgcggaagtagtcgagtccttcggatgcgaagtcgtacagtatgactggatgcctccggcaggcggaaacgttgaactgatcaagacattgaatttccttagaaattacgaaggattcgatattgacgaggcgaaccgttccgtaatcgccaaggttgtggcaagccagccggtcatcaaggatgtggttccggcaaaatccgtaattaaggaactgaacgaagggaaagtgatccttcatgcaggtcctccgatccagtatgagaatatgccggacccggtacagggatcctgcgtgggcgcggcgctgttcgagggctgggcatctacggaagaagaggcaagaaagatacttgcgtcaggagaagtgacgtttatcccatgccatcatgtgaaggccgttgggccgatgggcggaattacatccgccaatatgccggtattcgtagtagaaaatacgacggatggaaatgaagcatactgcaccatgaacgaaggcatcggcaaggtgctaagattcggcgcttactccaaagaagtcgtagaccggcttctgtggatgaagaacgtattaggcccgacgcttggaaaggcaatccgcacgcttggcggcctgaatgtaaatccactcgttgcaaaggctattgccatgggcgacgagttccaccagaggaatattgcggcttcccttgcattcttaaaagaggtaagcccagtgatcactaagatggagatggacgataaagatagatatgacgtgatcaagttcctggctgatacagaccagttcttcctgaatatcatgatggctaccggcaaggcagtcatggacggcgcaagacagatcaccgacggaaccgtcgtgaccgcgatgtgcaggaacggcgtggaattcggcatccgcatcagcggaatgggagacgagtggttcactgccccagtaaatacgccgcagggcctgtactttaccggatatgacggggaagacgcctgcccggatatgggagacagcgcgatcacggaaacgcttggagtcggcggaatggctatgattgcagcgcctgcagtaacgagattcgtaggcgccggcggatatgaagatgcccttcgtaccagcacagagatgacagagattacaatcgacaggaatccaaacttcattatcccgaactggaacttccagggaacctgccttggaatcgatgccaggctggtagtggaaaaaggaatcacgccggtgatcaatacaggaatcgcgcataagattgcaggatatggacagattggagccggaacggtacatccgccgatcgagtgcttcgagaaagcgattgtggcatatgcgaagaaactaggattttcattcgaataagcccgggaggacagtgctatggaaaagaaaagagtcgtaatcgcgctgggcggcaatgccctcggcaaggatatcgaggagcagaaggaggcagtcgccaagacggcgaaagtcatcgtagatctggtgcagcagggaatggaacttgtcatcacgcatggaaatggcccgcaggtggggatgatccagagcgcgatggaccagctctcctgcgactacaagcattacaagcagacgccgctgccgacctgcgtggctatgagccagggctatatcggcatcgaccttcaaaatgcgatcaagtatgaactatatagccgcggcatggacgtcaaggtatctacaatcctgtcccaggtagaagtggatcaggaagatgaagcgtttaagaatccgacgaagccgatcggcagatttctgaccgaagaagaggccagaaagaacgaggaaaatggaattccatgcatggaagatgcaggaagaggctaccgcatcgtggtggcctccccgatgccaaagaagatccgcgagcttaagaccatcgagacgctggtgaacgcggggcatatcgtaatcacctgcggcggcggaggcatcccggtagtcaatgacaacgggaaactctcaggagtcaatgcggttattgacaaggataacgcaagcagcctgctggcggcggaactgggagcagattatctgatcatcctgacggcagtagaaaaggtggcaattaattttggaaaagaaaatcaggaatggttaagcgaccttacggtagaacaggccagggagtatattgcccaggagcagtttgccaaaggatccatgcttccgaagatcgaagcagccatccgatttgccgaatcaaaagaaggccgccatactctgattacgctgcttgacaaggccgcagagggtatcgcgggaaagacgggaacggtaatacataagtaatttaggagataaaatatgaacgtaccaacaaatctgtttatgtggataatggcgtgcctgccaattattgtcctgctcgtattaatgatcaagtttcagtggggagttacggaagcagctcccgcggggcttgtcatcacaatcgtcacaggcattgtgttttataaggcggatatccggctgctggctgcggagagcgcgaaaggaatctggaacgcgctgatcatcgtattgatcgtatggactgcgatcctcatgtaccaggtggccgacgaggccaaggcatttctcgtgatccgaaacggaatgcgcaagctcctgcccaatgaattgctggtcgttctggcgctgggatggattctggagagttttctccagggaatcactggatttggcgtgccggtagcggtaggggcgccgcttctcatcgggattggcgtcctgccagtatgggcggtcattatcccgctgctcggccaatcctggggcaatacctttgggacgctggcggcagcctgggatgcgctttccatgacggccgctcttgagcctggaacgccggactatctggctgcggccttctgggcaggcctgttcatctggctgtggaatatcgtcattggtctggcaatctgctggttctatgggaaaggaaaagcagtaaagaaaggccttccggccgtgctgatcatttccttgatccaaggaggaggagaactgctgctaacccaggtaaatacgacgatcgcctgctttataccggcatgcatctcattaatagccctgttctttatcgggaagcttaagatctacagggaagaatggagccttgaggatagccggatcatgaaccggacattcacggctgaggcagcagaagaagttccggcagacatgtcgcttctgcaagccttcgtgccttacattcttttgacggccatcacgatggccgtgctagtagtgacgcctgtgaatacattccttaagcaggtcaccatcggcttctccttcccggagacccagacaggctatggattcgtaaaccaggcagaggcatgctactcgccgcttgcgccatttacccatgccagcatgtttctattcctttctgcgatcgccgggcttttgtacttccggaagcatggatggatcaagcagggcggggcaaaaaggatattcgcaaaatcagttgcaatggctattccatccggaattgctgttacaggcttgatcatcatgtcaaagattatgggaggaaccgggcagactgccgttctggcagatggaattgcgaggattcttggcaaagcatatgtgatccttgctccggtagtgggaatgattggatcatttatgacaggaagcaatatgtcctccaacattctcttcggggaattccaggtgacgacagccgggcttcttcatcttgacaaagcggcatttctgggggcgcagacagtgggaggctccatcggaagctcgatcagccccagcaatatcatccttgggactactacggcaggcatcctgggcagcgaaggacaggtcctgaagaagaatataccaattacgctgacggttactctgatcataggaattatcgtgttcctgtcagtcgttctataaatgcaggagcaaagtcaatatggaaaagaaaagtttttttaaaaccaaacaaggcggactgactatcgcattcatcgttatcatcctagcattcatcctgatactgtggggattaaggatgcggcaggatgcagcgtgcatggcgggctttatcttaatggtggctgcaatgctgtacgctccggtgaaggtatttgtaatagaccgtaataagaaaaagagttgaaaagaaagggtatgcatatgggtattgaggagatcacaggcagaatcgcgagagatttggagcacttaaagcaatatacggctacgccgggaaatggctgcacaagacttccgtttacggaggaggccaggcatgctgtggaatatttaaaggaacttatggtggaaagcgggctcgaagtaaccatcgatgccgctggcaacgtaatcggcgtcctgaaaggcgaagatgaggatgcgccttgcgttatgatgggttctcactatgattctgtctataatggaggagattatgacggaattgccggagttatctgcgctatcgaagtggcaagacttttaaaagaagaaggaatcaagccaaaacgcagttttgtagcggtaggattctgcgatgaagaaggcacaagattcggaacgggttatttcggatcaggggcaatgcttggaaatcgtgatgtggagtataccaagaagttctgcgacaaagatggcatctctatctacgaggcgatgaaggaatatggccttgagcctgagaaagtcagcgaggcggcatgggaaaatggaaaaatcggagcgtttctggaagcgcatatcgaacaggggccggttctggatgcagagaatatcgaaatcgggctggtagactgtatcgtaggaatccagagatatatggtgacggtgaatggccgcgcggaccatgcagggacgacacctatggatatgcgtatggacgccgtggatgccgctacaaaggttatatcaaagattgcggactgggcaagagaaaaggccgatggaaccgtagcgaccgtagggtatatcaatacggtgcccggaggcatgaacatcgttgcggagaaggtagagtttactgttgatatccgttccagaaataatgataatatcaatgatattgcatcccgtatcagaaaagcgctggaaagggaagtaaaggaatttggcggcaccttcgagatcgagaacaaacttacgatcacgccggtggaactttccgaagacatgctggacattatggaagaggagtgcaaggagcgcggatatacctataagagaatgttaagcggtgccggccatgatgcgctggaaatcggccaggtactgccgacggtgatgctgttcgtgccaagcaaagaaggcagaagccactgtcctgtagaattcacgaaatacagtgattttgcaaaggcggcagtcattatgcagaaactggcaaaagaacttcttgacaaataaggcttcggattggagcgatgagccctatgaccgaccagatgttaaattcaaagtataaaactgaaaatcttcgtttcctgaggacccatcttggaatgacccagaaagaattcatagaacggttcctgatcagggaagatggaacgcctgccatgagcgtcgccactttctctaacctggaatcgaagggcgggatccggcttgccgaggtcttgctaaaggcttcagaggccttgcagatagattccatgctattttccatggacccggatacctttgcccggaaaatcagcatccttctttctgacagcgcagatacagaaaccattggcagaagcgtggccaggacaggaaagattgaccagcttctctataagcttacgatgtattttgcagagaaactgatggataaagaactgaaaaagggcgataagatagagtcagacagagaattggccaaaaagatgaatgtgggacgctctgcgataagggaagcgctgaaagtactggacgtacttggcatgctggacatccgtccggggcagggaacctatatcagcagcgaagaagcaaattttttcattatccccttatcctggtccttattcctcaatggaagccagttgaaggatatcctggaagtgaggaatcttctggaagtgaaggcggcgcagctggcggcagaacatgcggatgatgctggaaggagaaggctttccctcctggcagaaaagataagcaaagcctatgaggagcaggaagagaaagagtttctggattatgagatggaatttcatagatgcgttgcacaatgttccgggaatcaagtcatctatagcatgcttgagaccatcagcaatcttatgcggcgtctgagcgccactgggatgacgggcgtgcatcagcaggaggaaatctaccaggaaaatcaaagaatctatagcctgattcttgccggcgataaggaaggatcggctgaggctatgcgagagcatatgaaacggtcaacacaaagatatcattacatataatcaggaaaaagccgcaggcgcgataattttgttatgcgtccgcggctttttatgctatactatatcatatgaaactgtacacaaatcgttgatggcggtgaggagaaagatgggatttagcgtaaatgacctgcttttggcagaagagttaaaagatgcgaagatacttggcggaaaagaaggactggacagacagatcaagggcgtgacgattatcgaagctccggatatcgtcaaatttattaatggaggagaagtcctccttacgggcctgtatgcattccggtcctgctcggtggaggaattccagaagtatattaatgaattgacgaagaagagcgtcagcgctctgatcatgaaaagaggcaggaaagtagaaaacgctgatatcaagatagagctactgctggaatttgcgaatacgcatgggattccggttctggaagtgccattcgagatctcctttcgtgacatcatgagccgcatcatggaacgcctttttaatgaagaagtgacgaggctaaagtattttaagacgacccatgataactttgcggcgttggcgctgtctccagactccggcaacagaggggcagataacatcctggatgtgcttgccaagctgatacataacccggttgcggtatttaaccagaacttatcctgcctggcagctacggaggatgcagcgagagtacttacgatcagcgaggatgcccggacgttcgagcctggcatctattccagctatacctatctcaggcaggaaggagaagagccccagtgcctgatacaggtaaagatgagttttcgggaaaaaatataccttgtggtgacggaacggaaccaggcgttggatgtcatggactgtatcgcggccgagagcgccatcactgcacttcgctttgagttttccagacagtatgcggtgacggaattggagaaaaagttccagaatgatatcatgcacaacatattgaatggaaagatacactcgatcggagaacttcagaagaatacgaccctgcttggagtggacatcaatggaagctaccgggtgatcgtattcggcatggccaatgagagcatgacaaaaggagattttaaggcaaaggttaaggatacgaacgttttaagccaggcaatcgtccactatatcaaggatgcaaagatacagaacgacctggataagatcgtcgtcatccaggcggtggataaagagcagacgcaggaggaataccgcagggagatcaagaagatcgtggagagcgtgcaggaagatgtgtccatgcataataagcatctgaaagtgaaggcaggcgtaggcaaggtggtggatggaatcatccatctgccggagagtttcaaggaagccaatgaagcgtttatgttcgtagatgtggccggggaactttcggaggaaggaagcccccaggcaatgctcttttctgacctgggaatattcaagcttctgtgccagctggaggatccctccatgcttctggaatatgtgccggaaggcctgcagaaactttataattataagaagccccagagagatgacctgatcgtcacgcttaagacctacctggatcggaaccagaatctttccaagacggcgcaggaactctatgtacactataagacggccgcataccggattgagaagatcacgaagatcaccggaatcgactttgacaacgccaatgaagtgctggcagtcagaatcggcctggtcgtctataagatgattgagaattataataaggattttatatagaacgtcatgaaaaaagataagaaagataatttatccagtctggataagctatctttctttttttatccttttgctccgatgcaatctgttaaaaaaatatctataatgtgcaatatagataagaagtttaaattcataaaaaagcaagtgtacaaatttgccaaagaaataaggcaaaatggagggattttatggaaatcaagctggaaagaatcctttcccgtctggaggaattgtaccaatgcggagcagcagcggatggaacctataccaggatggcctactcgccggaagatgtaaaaggccgggagacattcatgggatattttcggaaactggggcttgagccaaggatggatgcggcaggaaacctgattgtcagactggaaggggaagaccctagccttccggcaatcatgactggctctcatctggacacggtgccggacggcgggaagtacgacggagtcgtaggatgcgtggcaggccttgaggtatgcgagacgctccttgaaaatggaagaaggcttaagcatccgctggaggtgatcgtgttcaccgacgaagaaggattccggttcggaagcggcctgctgggaagcagcgcgatctgcggagaacagctgcatgtaagcgggacagacctggatctgaacggacaggcccgaagcgaggtgatgaaagcgtatggaatagacgtatcaggcgtttctaaggcgcaaaggccgaaggattccatacactgctttctggaactgcatgtagagcagggcgcatcccttgataagaaagggattccggttggggttgtatcatccatagctggtgtaagccgctatgagatcaccatcaaaggcgaggcaaaccacgcaggaagcacggtgatgaatgacaggaaggatgcgctggttgcagccgcaagattcatcgacaaggttcctgagattgtggaagagtatggaaacccatatacggtggctaccgtgggaacgatgaaggtggttcccaattcggtgaatgttattccgggagagtgcatcttcaatctggagatccgggatcaggacgcagggatcatcgacctgatcgaaggcaagttaaaagaacatcttgatcaggtatgcaaggagcgggaggaagaatatcggtttgagcgtttttcctatcatgagcctgcaccgatggcagattgggtaaaagaagcgatcgaggcatccgtaaagaatttgggaatcgaatatgcgatcatcccaagcggagcattccacgattcactggtgatgacaaacgtattccccaccggcatgatcttcgtgccaagcgtaggcggaatcagccactcaagatatgaatatacggcagatgaggacatccggcagggctgccaggtgctccttgagacgattctcaaagtagataacatgaacccatcatgttaaaaaatagtaaaacaaaggcaaaccaaaaaagaaaggaaggcaatgctatggaaaagaaaaaaattggtattattggcggaggaatttcaggaacatgtctcggatatcatctgagcctttatgataatgcggaggtagtcgtattcgagaaagacaccatcggcggagcatccactgcaaaatcagcaggaaccgtatgcctcttcgatgactcattaagaaacagatactgggatgtaagattatacggattcgagtcttatcttaagatggaagcagaagaaaaaggatccgcaggctttgacaagaccggtaccctggtagtggcaaccgatgaaaaggtagaggctaccatcaagacaggaatcgcattggctaaggcggctggctatacaggagaatatattaccgacaaggacagaatcaaagagatccttccggacatttccacagagaacatcctgggagcaggttacacgcaggatgatggatattttgacggaaccatgatctccaatacatatgcaaagaaaatgcagaaaaacggcggcgttatcaaaaccggcgtaaaagttacggaagtcaaggtagagaataacaagatcaaaggccttaagaccagcgagggagaagactatgaatttgactatgtcgttgactgtacaggaccttggagcaaatttaccggagaaatggtaggcatggatgtaccgatctggcataccaaggcagaagcattcttcctctgccctccaggaaagaaattaggatacaccttcccagtactgaaatatcctgcattctatgcgttaagggcaggcgacaacatctttatctgcaagtcccacctttctatggatctgaacaatccgatgcatgcaggacagtgggatccggacaaacttccggcaacaggcggaacagacgactacttcatcgacttcctgcttgaccagctggaatgcagagtgcctggaatcgtagacagcggactggtatcttcatggctgtcctaccgcgcggagccaaaagacttcctcccaatcttaggagagactccagtagaaggatatgttcttgcgaccggatacggcggaaacggagtcattgaagcaccggcagccagcagagaccttgcaaaattcattatgcgcggagagaagactccattgttagaagactgggcatttgaacgtctgttaaaataaacacgtgtaacagagaggagaaaatatgaatatagcagttcttataaaacaggttcctgtttccaatgacgtttctgttgatccggaaactcacgctctggtgcgtgcaagctcggaaggaatgatcaatccagcggacttgaacgccatcgaggcggcaatggccttaaaagagcagacagaaggaaaagtcgtagtatttacgatgggacctccggatgcagagaaggctttaagagatgctatggcaatgggctgtgatgagagctgtctcatcacagacaggtgcctggcaggaggagataccattgccactgcaaaggtacttgccagaagcattgagaaatatggaaaatttgacttgatattaagcggcgccttatccgcggatggagccaccggacaggtgggagccatggtagcggaatatatggggattcctcacgtatctgagatacagggaatcacatacgatgagaatatggcggacagcatgatcgccatcaagaaggcccagggaatggaatggaagatcaaggcttccctgccggcgctaatgagcgtatgcttcggatgtaacgagccgcgcctggctacccttcgtaccaagcgggcagctaagagcaagccgatggaggtgtacaccaacgcggaacttcagatggatgcaagcgagatcgggcttgcaggatcgccgacggtagtcaccgactcttttgcgccggagagtaccagaagagccgagatgcttaccggaactccggaagaactggcacgcaagctgcatgagttaatcgagattgagaaaggaaaagaataaatggctagtggaatttgtgttttcgcagaaaattataatggtaatatagaatctgtcgtggcagaactggttcgcgcagcacatttcattaaagagacaaccggcgagaagatacaggctgttgtcgttgccaaggactgtgatcatctcataaaacaattggaacagcttggcatagatgaagtatatgctgtcaaggcagacagagaatgtgcattccaggatgacgccctaagccaggtgattgctgagatgattcaaaggatcgacccgtcaagcgtgctgattccggcaacccctacggggcgctccatcttctcaagagttgctgcacgcctaggctgcgggcttacggcggactgcacagagttattagtagatacacgggaggacaacaccttttatatcaaacagaataaaccttccttcggagaaaatgttttcgtcacgattgtgacaaaagaaggattctacccccagatgatgacggtaaggccgggcgtatatatgccgtatgaggccgccgaagatagaaaggctgaagtcagatattttgacgatattgtccttccggaatctaaaatagaggtaatcgagtctgttccggcatccaatgagactgacagcatcctctcggcagaagtcgtggttgtaggaggccggggagcagaaagcgaggaaaacttcgcgctgttaaaggcatttgccgataagcttggtgcggcaatcgggggcaccaggccgctggcagatacaggattcattccgttcgagcatcagatcggacagaccggattcaccatccgtccgaagatctgcatctcccttggagtatccggagcaatacagcatacagaaggaatcaaagacacaaaattatttgtggcgatcaacctggatgaaggcgctccaattttcaatgtatccgactatggcatcattggggatatgaaagaggtgctggaatcctacttgaaattgtaatcaaccccccaatcgatatagcagatagaatcagaaaaagatatcttgacacggatatctttttctgatgtaactataagtagaaagcaaggaaaggatgatatttatggatttattagaaattatgagaaagagacgcagcatcagaagttatacgcaggagcagattccggaagagagcctgatgaagatccttcaggcaggccttttgtccgaatcagggaaggcaaagcgcccctgggagttcattgttgtccgtgataaggaaacacttgcatacctgtccggctgcagggctggcggcgtgaagatgcttaaagaggcgcagtgcgccatcgtggtgatcggagacgcgaaagagcaggatgtctgggtggaggattgctccgtggcaatggcccacatgcatctgatggcatccagcctggagatcggcagctgctggatccagggaaggctcagagagtccgatgaaaagacgacggaagaatacgtcagagaaaaactgggattcccagagaattataagttagaagccatcctgtctcttggcatgccggcagttaaaatgccagcctatcagctggaagaacttcctatggagaaagtgaagtgggagaagttttaggggaatggttttggatgcggacggcattatgagggggccgggaggatttcccttccgactcccttcgccgggaaagtataagcagaaaggccctgaaatgtaagcaaccggcatttcagggcctttctgctaacactttccaacggcttgctcgacagaaaggaaatcctcccgcctcctcataatacctgctcgtacccaaaagctgtaagggggatgtgtgccaaggctgaacttacaagcgtcccatcaggggttaaaaagaatcatgtgcaatattgcggtttcattaccaatatttttgtatgaatgaatggtgtcggccctgaatcgtatgctttcgcctttttcaactataaaactttgaccatcggcaagaatctcgattttgcctgtaaatattgtaataaattcagtggttccccttaaatgcggttcggattcccaatagcttccttcctctaattccagataatagactgcaaatctacggttctcgttatccgggaaaagagagtagtttcttacttttccgccatcttcaagcagaggctgaatttcggccgtcttcacaatctcatatggacttttcggacgaacggttaacgcgtcaaacggcactttcattccatttgaaattttccatagcgtggagatcgtcggattcccgtcaccgcgctcaatttgtgccagcatacttttactaacgccactcaatcttacaagctcgtccatgcttaatttattttcttcacgcagccgtttaatatttttagcgactatcatattcattgaatccaaaaaaatcactcctccctattgacaatataatgcacaaaatatattattatatcgtacaagtacaatataataatcattttataccattatattattattgcttaaatttgtaaagaggaaaggagttctgttcagttatgtttcatttatatgattttctgatttattgctttattacggcttacacgccgggtgcaaacaatctgctttccatgagcaatgccatacggctgggactgcgccggagcattcgttttaatctcgggatacttgccggatttgcaatcgttatgtctgtttgtaccgcatttagcgcaacgctctattcgtttcttcctaaagtaaagattgtcatgcagatattaggcgctgcttatatgctgtaccttgcatggaaggtctggaaaagttcttctgaattaagtacagatggcggtaaggaggccagctttctttcaggcatggtactgcaatttgccaatcccaaaatttatatttacgcaatcacggcaatgtcgctttatatcttgccggtttatcattcaggagcagcgctaaccgggtttactgtcatactatctctgattggcgcttcaggttcttttgtttgggcgctgtttggagctgcattttgtaaactcttttccaaacacacgaaactggtaaacgctatcatggcccttttgcttatttactgcgcgattgctctattcctttaattgtcagtctgcattagaaacctaatgattcgttatttgccgcactgtcaaaccagaggacgaatttcgaccgaatagcggagacagattaacaacgtggttgtctgctggtagatgaagaacagcaggaggatgggggagagggattgttacgacgctcctgggactgcgactcatgcactgatctgtaagccggcgaaagagtcgccgacagcggctcctcttttgccggctaacatctcaggcatggattctacgtcccatccgcttaccttcacaacccctctcccccatcctcctgcgtccttcatccaccaaagaaaataccaaagaagatgccaaaaaactaaattgagaaatggacatgtggacgggaatggattaaaatagatattactggtgcagtactgcatctagaagaggaagaggaggagacgggtatgcgaaggaaagaccgggaagtgacggatattgaaaagataaaggagatactggatgcctgcaaggtgagcaggatcggacttatggatcagggaaaggtatatatcgtgccgatgaaccatggctacagcctggaggatggccggctggtactgtattaccatggagcccgtgaagggaagaaactggaactggtgaaggaaaatccgcaggtgggattcgagatggattgcggccatgaactggtggagggaaggctggcctgccagcacagttatcattacgccagcatcataggaaatggcgaggccagagttattacggaaccggaagagaagctgaaggcgctggcggtgatcatgaagcatcagacgggaaaggagtttcaagaatttgagacgaatccaagacttgaaaaggccgtatcaatcataaaagtagaggtgggtgaatatacctgtaaatgttatggcaaaggatagaaaaggatttttttatacggcaaaaaagattatgaaactagcccggtccgaagagtttcagaagtttcagcaggagcaaaaggcttacgaagagacgtttgaggaacagaacgagtaccagagggagatgtttctggcaaaagaaggcaggcactacaggaatgattggagcagctggtgctttctgtgctgccagctgacgattccgttctggattctggggattctggaatgcatcatgtttccgaagcatgccatgctggatgcggcagtggcatggaccatgttttttcttcctattgcagtggcatgcaggctgttgaacctgtttataggccaggttctggccgtatttgatgggaagggtttttgggcgctttctgaagtagaacaaggtgtctataatatagagaatagggtaaaactggtctatattccctaccaggatgttgtggggatcgagtataaggccacgagaaccaggaatgcggttcgcaagtcggacttttccagtgtcatagtcagctgcaggcatgacgataatgggactggaactaagagagaagccgcatatttgcttcggtgcggcagaaccaccagcgctgcaagaaagtttgcccgagccgttgcaaagcggacggaaggaattgcagtggtgaaggatggcatggatcagaaggtttttgttattatcgctttgttttgttatgcaatcgtgattatgattctcgctttttctgatttccgttaagaaaaaagcggttttcgcaaattaatgctttaacttgcgaaagcaatgtgctatacttaacaggtaacaggcgtagtttacattttgcgcctgcttttcaatagagtaaggggaatgttccctttgggatgaaggaggaaataacatgatttgggcgaaggaagaaaccctgccaagagttgagattgagagtatccagcttaagcggctgaaggaggcggtacattatatctacgacagagtagagccttatcgcaggaaaatggatgaagcaggcataaaacccgatgatatccagagtctggatgatttaaagaagatgccatttacatataaagcagactttagagacaattatccaatgggattatttgcagtagataagaaggaactggtgcggttccacgccagttcggggacaaccggaaagccgacggtggtaggatataccaggaaggatctggatgtctggctgaataatgtagccagaatcgcgtgcatgggcggagcaacgccgcatgacgtggcgcagatcgcattcggctatggaacctttacaggggcgctgggactgcatggcggcttggagaaactgggggcatccgtaatcccaatgtcatccggcaataccaagaagcagatcatgttcatgcaggatataggcacgacgcttctggtcgcaaccccttcctatgcgctgcatctgggagaggagatacgggccaggggcctggacccgtcaaaagatctgaaggtgcatattggactgttcggcggagaaggcatgacggaacccatgcgggacgagatgcataaggtctggggagaacagttcctctgtacccagaattatggcatgagcgaattatgcggccccggagtcgcaggagaatgcgaagaattatgcggcatgcatatcaatgaagactggtttatcccggaagtgatcaatcccgagacaggcgaggtacttccgccgggagaacggggagaactggtcgtgacctgtctgggaaaggaagcgattcctttgatccgctaccggaccggagatttgacccgcctgttctatgagccttgcaaatgcggcagaacgaccgcgcgtatggagaacctctcaggccgggcggacgacatgctggtgatcagaggcgtcaacgtattcccgacacagattgaagaagtgcttctgcagattcaggagatcgggcctcattatgagattctcgtggagcggaagaatcgcctggatgtcatgacgatcacagtagaactggtagatgacagactgcttgacagttatatgcagttaagcgagctggagcagaagattaagaagggactgaaagcacagcttggccttgcaacccagattaagctggttgcgccatattccctgcagagatttgaagggaaagcaaagagagtgacagatttacgaaaggatggattataagatgtcagagaataagaaagtagttatgctgggcaacgaagcgattgccagaggggcatacgaggcgggcgtgaaagtatccgctgcctatccgggaacgcccagcacggagatcagcgaatatctggtacagtacaaggatgatttatactgcgaatggtcgccgaatgagaaggtcgccacagaagtggcgattggagcgtccgtagtaggcgtacgctctatggcctgtatgaagcatgtgggatttaatgtggctgcggacccggcttacacggtgtcctacatgggcgtgaatggaggccttgtcatcgtcgttgcggatgatccgggactctacagttcccagaatgagcaggataccagaatggtggcaagagcggcacagctgccggtactggagccgtccgacagcgcggaggcaaaggattacatcaaagtggcttatgagttgagcgagaaatatgaccgtccattcgtattccgcatcactacgaggctggcacattcccagggactggtagaacttaaggatcgtgtgacggtagaagataaggaatatgtaaaagatgtcaagaagacggttatgatgccaggcaatgcaaaactgcgccatgtagagattgagaagcggaacctggaacttgcggaggctgcggagacgctttctatcaatacagtcgagatgaaagatacgaagatcggagtcattacgagcggtattccttatcagtatgtaaaggaagcgctgccggatgcctctgtactgaagcttggaatggtgaacccgcttccgagaaagatgatcgaagattttgcatctaaggttgatacgctctatattgtagaagaactggatccggttatagaagaacaggtgaaatcctgggggatcaaggcaatcggaaaagagatctttaccgtgcagggcgaatacagtgcgaatatgatccgcagggcgattctgaaagaagaactggacatcgaccagccagcacagattcctggcagacctccgatcctgtgtccgggatgtccgcacagaagcgtatattacgtgctgaagaaactgaacatgcatgcagcgggagacatcggatgctataccttaggggcagttccaccgcttagcaccgttgatacgacgatctgcatgggagccagcatttccagcctgcatggtatggaaaaggcaaaaggcaaagagtatatcaagaactgggtagcggtaatcggcgattccacgttcttacatacgggcgtgaactctctgatgaacatgatgtataacaacgcgaccggaacggtcatgatcctggataactctaccaccggaatgaccggacatcaggatcacgcggcaaccggcaagaccttgcagggagacgccacctacgcgattgacattccggcgctctgccatgcgataggcgtgaagaatgtaacggaagtcaatgcatttgatatagagcagcttgaaaaagtcataaaagaagaagtggcgaaggatgaagtctccgtcatcatcacgaagtcaccttgcgtattgcttagcaaggcgaagaagccggtatatatcgcccatgaggataagtgcaggaagtgcggcatgtgcatgaagccgggatgcccggcaatgaccaggaagccggatggaacgatccacattgacgatacgatgtgtacaggatgcgggctttgcgagagcctgtgcaagtttgacgcgattgaattagtaaaggcaggtgacagataatggctacaaagaatattatgattgttggagtcggaggacagggaacgctgcttaccagcagaattttaggcggccttgccattgccagagggctggatgtaaaactttcagaagtacacggcatggcacagcgaggcggaagcgtagttacattcgtacgctatggcgagaatgtggcggagccaatcgtagaagaagggcaggcagatgtcatcattgccttcgaaaggctggaggctatgagatatgcgcactacctcaaaaagggaggggtgctgatcgtcaatgactggagaatcgaccctatgccggttgtcatcggagcagccgagtatccggcgaatattatagatacattaaaagagaactacaaggtctataccgtaaatgccacggaggaggctaagaaactgggcaattcaagagtatttaacttgatcgtgcttggaatcgcggcgcagcacatggaattttccctggatgaatggtatgacgttattgagaagaccgtgccaccaaaaacgattgacataaacaggcaagcgtttgatgttggatatcaattatagggaggtgtcatatgatcaggcaactatcagtattcgtggagaacaagccgggcagccttatggatgttacgtcaaagcttaccgaagcgcacgtcaatatccgggctgtagcgacttttgatacgccggaatttgggatccttcgtctcgtagtagataagccagcagaggcgaagggttacttgactgagcggggatttgtcgtaagagtccatgaagttatgggcgtggaattagaagataagaaaggcaatctcaatcagatgttggcaatacttgccgatggcaagatcaatattaactacatctattcatttgtgatccgcgaagggaaagcgccggttatggtatttaacacggacgattttgagaaagcagctcagattcttaaggaagcaaatgtgaagattgtagaagaatcagatttataaaattaagaataggagtaggaagaacatggcaggagtagcattaaaagactggaaagaacagatcagagatccaaaaattgaatgtatgagcagggatgagatgtccgcgcttcagagcgagcgtctcgtaaagcaagtaaagaacgtctatgaaaatgtagagttctaccgcaagaagatggatgatctgggcgtggagcctggagatataaagggaatagaagacattaacaaacttccatttacgacgaaggaagacttaagggacaattatccatttgggcttctggcagttccccaggagaagattgtaagagtacaggggacatccggaaccaccggaaaacttaccctggcttcctatacccagaaagacgtggacgtatggggcgagtgcgtggccagagggcttactatggcaggccttgacgcaacggaccgcatccatgtgtgctatggatatggactcttcacaggaggcatgggactggactttggagcaaaggctctgggggctatggcaattccgatgtcagccggcaatacgaagcgtcagctgatgtgcatggaagactttggggcaaccgcatttgcctgcacgccttcttatgcgctgtatctggctgaggcagcagaggaagcaggcgtcgtagaccgtcttcagttaaaagccagcattaacggcgcagagccgtggacggacgagatgcgtaagaagattgagggaatcctccacatcaacagttttgatatctatggactgtgcgagattaccggacctggcgttgccatggactgcatccaccataaaggactgcatgtatatgaagattatttctatccggagatcctgaatccggctgaccataccgcatgcgcggacggtgagacaggagagcttgtcttcaccactcttgccaaagaaggcatgccgctgatccgctacaggaccaaagatctgacaagcattgagtacagcacctgcgagtgtggaagaacgcttccaagaatccagaagtttaccggacggacggatgatatgaaggtgatccgtggcgtcaatgtattcccgacacaggttgagacagcgcttctttctatgggcggcggcgtagcgcctcattatatgctgattgtagaccgcgagaataacctggacgtacttacggtaatggtagaggttgatgagaagtacttctcagatgagatccgtaagctggatgaacttaagaacagagtgggcgccgtattaaagcaggcattgggcctggcagtaaaagtaaaactcgtagagcctaagacgatccagagaagcgaaggcaaggcaaaacgtgtaattgacaacagagatctgtaaaaggaggggaataaaagatgggtatgagcaatacgattcagcagttatcagtatttatggaaaatagagaaggacgtctggatgagatactgaagatcctttcagaggcaggcgtcaatatcgtggcacttagcctggcagatacctcagagtacggcatgctccgcatgatcgtatcagatccgcacaagggacgcgcggcgctgaaagatgagggaatcaccgccatgctgacggatgtggtggcgcttcgggttccacatgccacaggctccctcagcaaagcgatgcaccagatcgtagagggagaagtaaatatcgagtatatgtatgcatttgccaacggaagcgatgctgcagcagtgcttaagagcgatgatcctgcgagagtaatcgacatcctaaaaggcagcgggttcgacgtatacagcgcggacgaggcatacagggctaatatgtaagagaaaatcgcaggaaagttttctgggatttatagtcggtggtcagaaatggccaccgataatttttttattcaaaaagagaccagtatatcagattttagcagatccattaagagttgccgggcatcttcataaagtttcttaagagggacgttttcggaatgcccttcattgatgaatcccaccatgccgtagcagaggaagccggcgattctctgagtagaatattttaactttatgacccggctttctttggcggtatgcatttctaccgtctgaagcacatagttgtagaaactgaaggccagatggggattctcgtcaggagccgtgtggcggaagaaatccagattgtcgtagaacaggatcaggatgctgtccagcacgttgcagtaactgaccacaggatccatctgcgggttgttttctatctgcatatcttcgtaaatcttcgttccagcctcgatcatgtccatgaaaatatcgtctaccagggcatatttatcactgtaatgggtgtagaatgtgatgcggctcgtgtctgcacgggtgcacagttccgtgacggagatacgttcaaaaggcatatcctgaagcatgtctatcaaagtgcgtttgagatttttctttgtcttctttatccggcgatcttccataaatttacacttccttaaatttgtataaataactgacagatcccggaatttgtcaattgttaagaaaccgggcgctgtgctataattttaacacgtgtaataataacggtcaacgtgtaaaggaaacagaaaaggttatcaggaggttaagatgtctgatattgcggtaatgacagacagtaattgtggattactgccggaagaaggcaggagatatggaatcagcattttgcctatgccggtattgatagacggaaatacatattatgaaggagtagacattacgtcagagatgttttatgagaagcagaaggcaggtgccttgatcacttcgtcccagccttcgcccggagacgtgatggggatgtgggaccggcttcttaaggagcatgacgaagtggtatatattccgatgtccagcgggcttagccagtcctgtgcaagcagcatgtcgttcgccagggaggaaaagtacaaaggccgcgtattcgtggtggataatcatagaatatccgtaacgcttacccacgccgttctggatgcgcttaatctggctggggaggggaagagcggtgcgaagatcaaagagattctcgagcgagaggccatggattccaccatctatattgccgtggatacgctggaatacctgaaaaaaggcggaagggtgactgcggctggcgcggctatcggaacggctcttaacattaagccggtgcttacgatacaaggagacaagctggatgcatttgcaaaggtaagaggaatgaagtcggcatttcgcactatgtgcaaggcgcttcataatgatattgagaccagattttcacatctgcatgaacatggaatgcttcaattggggattgcaaatacttggatggacacggagacgatcgagaagtggaaacaggcgctgaccttggaatttccgggaatggaactgacccatataccgctgacgctcagcattggctgccatacaggcccgggagcgctgggaatcggagcagtcagaaagcatactctataaaaggaacttcagcctaggagagaaaaggctggagtttttacttttcttaccacaatattcatgttatcctagaaagaaatagtaagaactatgcctggaaagggcgtctggaaagggggcaaccgcaggttgacaaattaccaggtgctgttttcttgtggattggacggacatctactattctatatgcatcaaaaggaaaaggcagggaaacgatatggaattttcagagaaattaatacagcttagaaggaaacaggggatgtcccaggagcaactagcagaccgtctggggatcacgcgccagtctgtcagcaaatgggaatccggcgcggcgcttccggaattagccaaattgatcacgctgtcagagatgttccaagtaagcatagactacctggtaaaagatgccgaagagccaaaagaggcagagagagaagaaagcaggcgcctggaagaaaaggtggacaacatcgtccggtatatgagaggatatcattacacaagcaagaccacgataaaaggcgtgcctcttgtatgcgtccggctgtccaggcggctcggcaaggaaggggtggcgaagggaatcattgccgtcggaaacgtggccattggcgtgctgtcatttggctgcgtctccgtgggcgttatcagcattggctgcctgggcattggaattctggcgttaggctgcatcgccgttggcctgatggccttgggagcaatggcagccggaatcgtagcgatcggttccctggcggtcgggatctatgcggccggcgcggcggcgtttggaaaagaagtcgcgatcggagccgctgcacatggcaatacggtgattggagagtccgtgaagggagcgcattgcctcagatggtacagcggacttagcgcagaggaggccaggcggtttattctggaaagccatccccgcctgtggagtcctctgcttaagtttctcgccgcaatagccggcagcatgggaagataagggataaggctatggaaagagaggagataaggatgaattttttagaagaacgtatattgaaggatggaattgtaaaggatggaaatgtgctcaaggtggacagtttcctgaaccatcagatggatatcgcgctgtttaatgagattggaaaggaattcaagaaacgattcgaaggaaagaagattaataagatccttaccatcgaagcgtccgggatcggaatcgcctgtatcgtggcacagcatttcgacgtgccggtggtgtttgccaaaaaggctaagagcatcaacttagagggagagatgtatgtggcggaggtagagtcatttacccacaactgcaagaatcaggtgatcgtagcccagaagttcctcagtgaaaaagaccatgtcctgatcattgatgatttcctggcaaatggctgcgcgcttcagggcctgatccagattgtgcagtccgccgaagcgacggtggaggggatcggaattgtcgtggaaaaaggattccagccagggggaaggatcatccgaaatctgggaatccagctggaatcgctggctatcgtggaacgtatggattcttcgaccggcgagattgcattcagagcgcaagaaggttagaaagaagatggaaaagacaatcttagtagtagaggatgaccggggacttaaccagggcgtggctatggcccttaagaatccgatgtatcatttcctgccggcctatacattgaaagaagccattgaatactggaaagataatcagattgacatggtcatcctggacattaatctgccggatggaagcggctatggattcttagaatccgtacggaaggaatcgcagattcctgtgatcatgctgacagctaatgacatggagatcgacgaagtgcgaggcatcgagatgggagcggatgattacattacgaagcctttcagcctgatggtccttcgggccagagtagagcgcctgtttgccagggcaggcagacaggaaggcaaggagtttcaggaggaaggatatcgattttcctttgaccgtcaggaattcgcggtggaaggaaaacccgttgtactaagcaagacggaacagaaactcctgcgaatgctggttacgcgtccgggacagacgcttaccagagagattctcaatgaggggatctggcaggaaggctcggattatatcgatgagaatgccttgtcggtcactgtggcaaggcttaggaagaaattaaaactttcaggagaagaatgtccgatacgtacggtttatggaattggatacgtgtgggagagagggaaggaaagatgagcatattgaggaccggaaggacgcttaagcgcttggatgagatgctgacggatgcgatcgagggaaggtttgaagagggaaaatatgatgagacagaactttccaggctggaatcccggtggaagcagtatctgaccacatccaaactgtcggtagaagcagccagaagggagaggacagatatcaagtcgatcctgtccgacatctctcatcagacgaagacgccgctttcgaacatcattctatacagcgaactgctaaaggagcagccgcttaccccggagggggtggagatcgcggaccagcttagcggtcaggcaaaaaaattggaattcctgatccaggcgctggtcaagatgtcccggctggagagcgatattctggaagtaaagcctaaaaagcagcctctggcgccgctggtggagcgggctttaagggatgtatcatccaaagccaggaagaaatccattacgattaagcaggagccatttggcaggattcaggccgtgtatgatttgaaatggacccaggaggcgctgtttaatatacttgacaacggcgtgaaatattctccgcccgggagcgccatcacggtaagcgtgaaagtttacgagatgcatgtatgcatccaggtggaagacgagggtccggggataccggaagaagagcggaccaagatctttcagaggttttaccgcggggaggataaccagcaggaagaaggcgtgggcatcggcctgtacctggcccgggagattctcagaaaggaagacggctatatcaaggtaggcccgggacacggaaaaggaacggttttcgggatatatctgggaatcgatgaattctttcagaactgttagaatccggacagaatgtggtaagacttatcctgtaatatattagatagcaaaggagattgtacttcagtgcagtctctttttcttaaaaaaagaagcaggaggcattaggtaatggcaatattgaagacagaaaacctgaagaaatattatgggaaagatacgacactggtgaaggccctaaacggggtggatctggaagtgggaaaaggagagttcctgtccattgtggggaccagcggctcgggaaagtctacgctccttcatatgctgggaggcctggaccgccctaccagcggcaaggtatatgtagatggcaaggacatcttcaaactaaaggatgaagaactcaccatcttccgcagaagaaagatcggcttcgtgttccagaactacaatctggtcccaatattaaatgtatatgagaacatcgtgctgccaatggaactggacggaacccgggtggataaaaaatatgtaaaagaggttataaagaccctgggactgcaggaaaagatctacagccttccatcccagctctccggcggccagcagcagagggttgccatcgcccgggcgctggcggcaaagcctgctatcatcctggcggatgagccgacgggaaatctggactccgtgaccagccaggatgtattaagcctgatgaagattaccagccagcgttacgggcagaccatggtgatgattacccacaatgaggagattgcccagatgtcagaccggatcatccgtatcgaggacggcaagattaccggcaaaggcggtgaggcaaatgcgtaaggtagcaaataaagaagccgtgcgccgcctttccgacaggggctttcagacgaataaactgagaaacagcatagcagcgatcgcgatcgcacttacggcaatgctgtttaccgcccttttcaccatagggattggcgctcttagcacgtttcagatgcagacggcaaggcaggctggaggggatacccacggcgtgatcaagaatctgacaaaagaagaatatgagacgctaaaggagcatccgctgatcaaggagagcatgccctgcaagctggtggcggattatgtgcgcaatccggaattcttaaagcggcatgtggaggcatggtattatccaaagaatgcttatccccactgttttatagagattcttaaagggaaggctcccaagaaggcagatgagatcctgttagacgagacttccatggaattgctgggattaaaaaaggagccggggcagaaggttacgcttcagctgcaaattcgccagtatgatgaggcgattacgaagcggacatttacggtcacaggaattacaagatccgatccggccctgaacgtaggatttgccatcgtatcggaggcgtacgttgaggcgcatgccgacgagcttgtctacaatgggattgaccacagggagtctcagacaggttcgatccgtatggatgtcatgttctccaacagtttcaatatccagaagaaactggatcaggtgatcacggaaagcggatattctatcaaggagacggatgaaaactatatcgcaagcaacgggaactgggcctatgtatccgacgaggcagatgcagaccctatgaccatgggggctgttgcaggagggctgcttctgatcctgctgaccgggtatctgatcatatacaatatcttccggatctcgatcatgaaggatatccgttattatggcctgcttaagaccattgggactaccgggaggcagatcaagcggatcatcagacggcaggcgctgaaactgtccctgattggaattccagtcgggctgctggcgggattctttgtaggaaaaggcctggtgccagtgatcatgaaatcattgggagatatagtggaatacagcacggtgccggcaaatccgctgatctttatcggagcggccgtctttaccctggtaacggtattcatttccacggggcatccggccagaatggcagcccgggtatctccgatcgaagcgctgaggtatacagagggaagcaaggcgcgcaaaaaaggaaagcactctttaagcggaggcaggatatggcggatggctatgtcgaacctgggaaggagcaagggaaagacgacgattatcattgcgtcgctgtctctggcgatcatccttctaaacagcgtatttacgataacccattcgtttgatatggataagtacctgcaaagttttataaagccggatttcctcattgcaaacgcaaaatatttcggcatggacaattatagaggaaggaacttagaaaccattgatgaggaaaatctgacggagtcgtacatcgaatactgccagggattaaaaggctatgaagatggcggaaggctctacggggcaggttccttcgtgggcgtaaaacagaaaggcatcaccattcctcccggaatagaacaagattcaaacggaatgcccggggaatactatgggaaagaattcattccaattgacaccaatgagcagggtgattttgaagtgtatctctatggggcagaagactttgtcgtaaatgagatgcaggtctgggaaggagaaagcgatcttaacgtcattaaggacaaattaaaaacaggcgattatattgtgtatgcagcgccggttaccgataaaggggcaatccgaaaagaccgggtcctgaaccatccgggtgacaaggtaacccttacctacaaggatcaaaatggggagccaaaggaaaaggaagtgacggtattgtccgttatcaaggaggactattggaacttgaccacccgcatgtccgcctattttccatattatataggggcggagccatttaaggagatcgtttcgcagaagttcctgatgtcatactcttttgatgtcaaagatggatatgcgagagagacggacgcagcattaaagggctatacgtcaagcactgagccattgatggattatagttcaaaactacaatatgagaaaagtttctatacgctgacgaatatgttcctgcttatcggcggcgccctggcttttgtcataggagtgatcgggatcttgaactttgtcaattccatactaacaggaatcattaccaggcagagagaatttgccatgatggaggccatcggaatgacgaagaggcagttgacaaaaatggtgatggcagaaggactttattacgccgcactgaccatagtattctcgtttgtggcgggcagcctgttctcattgaccgcagtaaggacattgtccgggggcatgtggttcatgcagtataagttcatgatcacgccgatgctggtggtattcccaatcctgctgataatgggagggctggtgccttacctggcattccggttcggaagaaagggaaccgtggtagaagaattgcaaaaagaataagcagactattaagaagtgcagggccgcctggttttaagggcggtccttcgttgttttttcaatcccttgaaaggtcacgctttgcctcgcagcgatgcgtcgacgcatgaatggactttaattttgaaagaagaaaagatttttgttgacacttgtgaaaacaatgctatgataacatcatgtgacattccaggatagggggaaaaggctatggattaccaaagaatcgtgcagggaattttggatattggagaagcgatgctaatctgcggagcggaaaatttcaggctggatgacagtctttatagaatgtgcagaagctacggctttaaacgttatgatgtgtttgcgatacccagtaatatacagataacggtagaaactccagaaggcgagattataactcaggtccggcatattgaatctacagatatagattatgaccgattggattatctgaataatctgtccagatatgtatgccagaataagccggatgaacagacgcttcgcgagaaatacgaagaggtcatgaacaggcagtcccagaagccgtatacgaagtattttgcggctgtaatggggggaaccggattcgcagtattctttgggtgcaactttgcggatgcggtcgttgcagttattgtctcgcttatgattgttatagtaggaggatggctcagcagaagagaagagaatctgctggcctataatatgatcctatcttttttgtcagaagttattattatcctggcggtacggatggggcttggcagtcatcctgagagaataatgataggaattgttatgctgctgatcagcggtcttagtaccaccaatggaatccgtgaagtgctgcaaagagactttatatccgggacgctgaacatcatgaattctatgcttggggcggctggcattgcatgtggaactgcgcttgcgatgctgctgcttaatggagtgtctgcggaagggtatgtactaaaccataatgttcagattcagctgatatcctgtacagtggcctgtattggatttgccttttggtttaaaatccgtgggaggcaggtggcttattcagggataggggctttttttacatggggaatctatgtcgtgatctatcatttctggcctagcaattttttggccacgctggttgcggcagtgtttgtggctttttatgcatttatcatgtccagaatcaataaggcgccatccacgatctttttgacggcatccgtattcccgctgattcctggaccgaatttgtattatatgatgtatggctgcgtgagccgcgattatggaatggcacttggcgagacgattgtattgctggctacctgccttgcaattgcttttggctttaatattgtggatattatatcaaggacaatcatgagagtcatgaaaagagagtatcatattgggaaaaatccacagggccgggaataaagcgactcatgcggtatcattatggatcattcctccggggaatgattcataatgataaaaagacatttgcaggcagagaagatatgttctaaaatgaagggagcagcggctgatcatatggaaaataaagtctggccgcagggggtatgaaatgaacgagattgtaaatagaaccttatatctggaatgctattccggcatcagcggcgatatgatggctgcagcgcttctggaccttggagcggatcagcaggcgttaaaggatgcgcttgagagcttgccggtggaaggcttccagatcgaaatcggcagggtaaagaaatccgggcttgatgcctgcgactttgcggtgatcctggacagcgctcatgaaaaccatgatcatgatatggagtatctgcatggacatggagcggtacatagccacagtcataaagggagccatgagcaccgtgggatgaaggaaatcctgcatatcatagagaatggcgcaatgacgcagggagcaaaagcaatcgcaaagcgtatctttggtatattggcccaggcagaagccaaagcccacggcgttcctttggaagaagtccatttccatgaagtgggcgcagtggattctatcgtggatattatcagcgtcgccgtatgtctggataatctggggattacagaatgcatcgtccctgtcctgtatgaagggtgcggcaccatccggtgccagcatggcattcttccggtgccggtgccggcggttgcgaatatcgtgtccgaacacaatctggatcttagcatcactgaatccaagggcgaattcgtgacgcctaccggagcggcgatcgtagcggcgatcagaacctcgaaggtgctgccggaagtattttccgtaaggaaaataggcatgggagccggaaaaagagagtacgacaggcccggaatcctaagagccatgctgattgaagggcaggcatcttatggcagagactgcatctggaagctggaaaccaatatggatgactgcacgggagaggcgctggggtatgtaatggaccgcctctttgaggccggagccagagatgtaagctatacgcctgtctatatgaagaagaaccgtccggcttatcagctgaacgtcatctgtacggacgaaaatgtaagacagatggaggagatcatatttgaagagacgacaaccatcggcatccgcaggcagcagatggagcggagcgtccttgcgcgcagcatggagacggttcgcacaagcctcggggatgcgcaggtaaaagtatgcgctctgggcccgcagaaaaggaaatatccggaataccagagtgttgtcagactttgcaaggagcatgatagatcattccaggaggtttatcagctggtcctttcggagtgtatgaaggaggaagagagtcatgaaatatagagaactgggacgcacgggacttaaggtcagcgagatcggcatggggtgcgaagggtttgtagacaagtcctatgagcaggtaaaagaattcgtagatgtcatggaagagggcggcgttaactgtattgatctgtacgcgcccaacccggatatgcggtccaatctgggacgcgcgcttcggggacggagggagcgattcgtccttcaggctcatctgtgcacagtctgggatgacggacaatataaacgtacgcgcaatatcgaacaggtgaaggcatccttcgaagaccagctgaagcgtctggaaacggatcatgtagagatcggcatgattcattatgtagactcgcttgcagattgggagcaggtgaaagacggcccggttatgaaatatgcgcaggaattgaaagcctccggcgccatcggatgcattggcctgtcaagccataacccgcaggcagcgcaaaaagcggtggaaagttctttgattgacgtgctgatgttcagtattaatccgtgctatgatcttcagccggccagcgaggatatagaaactctgtgggatgagaaaagttatgagaagccgctggtgaacatggacaaggagagacaggaactgtatgaaacctgccagaggctgggagtggggattacggtaatgaaagcgttcggcggcggggaccttttgagcagcgaactgtccccggctggaaaggaactgacgccttatcagtgccttcactatgcattaacccgcccgggggtggcgacagttatgtcaggagcccggacggtcgaagatttgaagatcagcatctcttatgaggatgcctcggaggaagagaaggattacgcggcagcatttgcagcacttcccaagatcagctggaaggggcattgcatgtactgcggccactgcgctccctgccccaagggaatcgatgtggcttctgtcaccaagttcctgaatctggcaatcgcccagggagaggtgccggagacggtacgggagcactatgccattctgccccatatggcagaagaatgcgtcgcgtgcggggcgtgcgagaagcgctgcccgtttgaagttccggtaatagagaatatgaacaaggccaaagaaatctttggaaagtagaacactgctaaatttctaatacataatgcaaggtatctgcacaatggatggctagggaatcgataaaaggaacgggccctgtgattgtgcctgctagcataggaagctcggtacatcctagtatcacgccgtcaagagaatagcgggcgctatatttttcgactatggataaaaaacgttcctgcgagctggcctttatattatttcgggcaagttcatcgaagataatatgatttatgatatcctggtctccatcggatggggagatgacttctatcccttgactttttaactcgtcgcggtaaaaggatccctgcattgtgtattttatgccggtaagaagcagttttttcattttgtttttccgggcgtacttgccgacggaatccacaatgcttaacattggtaccgacgcttctttttctatagcatggaatacggaatgtggagaatttgctgacattatgattatgtctgagccggcggattccagattgcgtattcctttcatgatatattccttatatccgtccatgtcgtttcgattctcgaaatcagtgaagtattggaagttgaggctctcaatacaaatttccggatagtaataatccttttttatctcgtaatataagtcgagtattttattgtaatattgtacggttgacgcggcgctgattccgcccagaattcctatttttttcatcttattcttcctttcgtcgcaaatggcctgtgctgatgtctgcctctgtgaacattgtacaggagaaaaaagaaaaaggcaataaagcgatctggaagaatgcgtcttaaataggggaattcgatgctcaatatagaatttctatattggattcccggcccctgtatatttataattagaactgaacttgatcgggggaaatatctgctgcatgcgtatatagatataggcggtcatagcacaaaaaggaggacgatgccggctgggcgtcagttgggattatgcatggttttgactttgaactatcgacaaacatacattttggaaaaggcaagattcagggattgccggaagagatcttaaagtttggctgccggatactgctcgtgtatgatgtggcagcaggcagaaagagcggcgcatatgaagaggtgcgtgctctttgtaaagaacatcatatccatgtgaccgagttcacgggaattgaacagaatccgaaacatactgctgtcaatgaaggcgtgcgtctgctgaaggaatgtggcgctgagtgcattgtggcgctgggaggcgggagcaccatcgatacggcaaaagccataggattttctgtgttccacaatggaagctgctgggacttctatgagaaaaaagcggtggtgacgaagatggttccggtcatctctgtcccaacgattgcagccagcggctcggaagtatcgaatatgtcgatcatcagcaatgtaaaagaaaagcggaaactggattgccagagcgatatggagcggccggtggctgcatttattgatccctcctatacctattcggtcccgccttttgaaaccgcctgcgggattatcagtattatgagcaatgcctacgaaggatatttcagccgggctgccggagagattcaggatggcatctcggaggcgatccagagatcctgcattctgcatggaaggcgggtcatggcctgcccttgctcttatgagtccagggctcagctgctgtggtcggcatcgcttgccatcacccatctgtcagactgcggacgggaatatgctggatgcgtgcattcgatcgaacatgccctgagcgcgtttcttgacatatcccatggggtcagtctcgcaattgcctcgcttgcatggttcaaatatgcattgtgcgatgaaacagcgccaagatttgcccggtggggaaggaacgtatgggggattaatgccggcaaagacgactttgccataggggtggaagcagtcaagcggtttgaagcgtttataagggaactgaatctgcctgccagactatcagaaatagggataaaaattccagaaaaagcggcagtgcagatggcccataggatttaccctgccatcgatggcgctgcctggttccgaccgctgtccggggaggatgatctggcggaggtattcaggctggcctgctagaggtattgcaaattgggaatggaaggagggcatcgggagaacctgatgtcgtgaaaaacgatgagccaaagtacgatagcgatcattattatattgatcataacagttttatatgcaaccgaagtgtttccgctggctgtcacctcgcttcttgccatgtccgcgatggtggtcacgggaatcattgattggacggaggctttttccgggttctcttcttccattgtgctgatgctcataggcgtgtgcattatcggagaggccttttttaccacagggctggcagaatccctgggaaatatgctcaaaagatttgcggatctgaaagagaaatattttgtggtcatcgtatatgtagtggcatccctgatgtcagcctttttgaatgcatctgcggttatggcgatcctgatgccggtggttgacagcctggtcttttccacagacgggaagatatccagaaagcatacctatcttgccatggggattggctccatatttggcgcgaatctttccattatcgggtctacgtccatgtacatggcccatactttgctgaaggaatcagacggagcaggaatgacattcttcgagcctgcgctatcgggggctgcggcttgtatcgtgggcatgctgatctatctgaccttcggctataattaccagaagagatgctttgattttaaagagaggctgccggaaatcatgacgcggacgaatgcatgcagttccagggaaatccgggaaagaagtatgacctataagccatggaagcgcaactttgtggcgcttaccatgattggctgtatcattgcgtttatctgcggctatgatattggcggcgtggcaatcatcggcgccagcatcgtgatggcggcaagatgcatcagcgagcgcagggcctaccaaggggtcagctgggagacggtattcataacggcggcatccatgggatttgcagccggcgtaggaaagagcggcgccggggaagagatcgcgaatttcgtgatcagagccagcggcaggattggagagaccagtgttggcatgtgcatgctcattctggtgctgagcacagtcctttcaaattttatgtccaacatcggcgtagtcgtcttgattgtgcctatctgcctgaaacttgccgcaaccatgggagtggacgcgacaccctttgttatggcctgtgccatcggaacgaatgtatctgtggctacgccagtctgcgtaggaccgattaccgttaccacggtggccgggtaccgattcaaggattatgtgagggtgggaggcctgttcaatttgctggctaccattgtaacggggatttcgctttgggcggtctattatagataaatgcaggatcaatgaaaagagggccggattttattccggtcctctttttataatggagtctctatgatagcttgtaatatcagtacccaattgttggtaaagttccttgacggagaggcccttttccttgacagttagaagttcctcgttggtaacgcctataaattccacaaaatctacggctccattcggcgtgtctatcttctcgatctttggctcgggaatcgtaataaagcctgtaatgttggagttcatctgcgtatcaatgccctgggtctggccggtatagacgaattcatacgcgtgaaacaactcgccttttgtaaaagtgattcgggcaagggactgaagaatgctgcagattcccttgatttccgcctcttcatcctcgcaggagcccttttccagcttgaatgtaaattccatcccgtaaccgctgatctctggttcatctgtttccttttcatagatttctgacagtccataggttatgaaatgccagtaatcgcctccgtcgtagatgctgatgccatccagaggatcatttccgccaagccgccattttatcagtgttccgtaatgcctggggttctcttggccaggatacaaggcatcaaatgcttctgaaatggcgtcccagccgggcgcctctgagttttcgccttgcacctcttgctgaggaggttcgttagcttccttttttcttttgaatttatctaagattcccatacatttatatcctttatatgcttgctgatatatagttccatgccataaccgactgggtatgaccttatatagaagtataattgggcttattccttgcgtcaagcaggaaagaaacgagataaaaatgattggaattggctaaaccagataccaaaaacgaaaagacaaaaaatgtgcataaaaagcgaaagaataatagtgcattatacacaaaaatattgctttaaattgacaaatattctataaaatattataataatcatacaatgacagaaaaataacaaaaactggtatgaccagaaaaggagttgtgagtgatgggagaattcagggttcttgaaatcaagcagagtgtttttgcggataatgacaggcgtgcaaaggaactgaggaaagaattaaaagaaaagaaggtatttctgctgaatcttatgtcttcgccgggatcaggaaagacgacgactctgtcgcgtacgatcgagcggctgaaagacgagatgaagatcggcgttatggaggcagatatcgattccgatgtggatgcgaagacgattgccagcctcggagttaaggcaatccaacttcataccggaggtatgtgccatctggatgcagatatgacggcgcagggacttgccggactggagactggagatgtggaacttgccattctggaaaatgtgggcaatctggtatgtccggcggaatttgatacgggagcggtaaagaatgccatgattctaagcgtgccggagggagacgataagccgcttaaatatccgctcatgttttccatctgcgatgtagtccttattaacaagattgacgtgctgccgtattttgatttcgatatggaggcatgcaggaagaatattctgatgcgtaatcccaatgcacggatcattccaatctgtgcccgtacaggggaaggcatggaggaatggacggactggctgagagatcaggtaaaggaatggaacgcatagcgtacaaaaagataagcggagaggagagagagaatgtcagaacgaagggaattgattttgcagctgggtcagatgatcacagaccggatcggccataaagtgactacggaggatccggaatactgggggcttgcctgtatcgtcaccgatgagatggcagaagtagcgttaaagatgaaggtgcgaaagcctatgacgtttgagcagatgctgaaggctacggggaaagaggaaaagaaacttcaggaactgctggatgaaatgagccgggtagggcttatcgaatacaactgggagaatccaaagcgggagaagcagtatgtgcttccgatgttcgtgccgggcagcgcggaattcaccaatatgaataagcagcagctggaagagcatccggaactgggcaggttcttcgagcggatgtccaggcttcctttggagaaggtaacccctatggttcctccgggaggcgcaggcatcggcatgcatgtcataccagtggagaaagccattgagatggagaatcaatccattgatatcgagcatatctcccattggcttaagaagtatgacggcaaatacgccgcaagcccctgctcctgccgaatgtcccgccagacttatgatgaaggctgcgccgatgatcccgaagactggtgcatcgcggtaggagatatggcggactatgtggtggagacgaataagggtggaagatatattacatacgacgaagtgatggagattcttaagcgtgcggaggataacgggttcgtgcatcagattaccaacattgacggcgagaacaagatatttgccatctgtaactgcaatgtgaatgtctgctatgcccttcggacctcccaactgtttaacacccccaatatgtcccgctctgcctatgtggcaagagtggagacgcaggactgcgtagcctgcgggcgctgcgtggagtattgtccggcaggcgcggtcaaactgggacagaagctgtgcaccaaggacggtcccgtctcctatccgaagcatgaacttccggacggcgcaaaatggggaccggagaaatgggatgaggattaccgggataagaaccggatcaattgctatgataccggaacggctccatgcaagaccgcctgtccggcgcacatcgcggtacagggatatctgaagaaggcggcccagggcaagtacagggacgcgctggcgctgatcaaaaaggagaacccattccccgcagtctgcgggcatgtgtgcaaccgccgatgcgaagatgcatgtacccggggaacggtggaccaggcagtggccatcgacgaagtgaagaagtttatcgcccggcaggatctggaagcagagaaccggtatattccgccaatcgttcctcctacgacaggacggctgttcgaagagaagatcgcgatcatcggaggcggcccggccggactaagctgcgcattctatctggcggagaagggatatcgtccggtggtattcgagaagaatgagaagccgggaggcatgctggtgtatggcattccatcgtttaagctggaaaaggatgtggtggatgcggagatagagattatccgccagatgggcgttgagatacgctgcggcatcgaggtgggaaaggatatcaccttggatgaactgcgcgcccagggatatcaggctttctatcttgccatagggtgccagggaggaagactggcaggcatccctggcgagacggcagaaggcgtgatgacggcggtagacttccttcgcaagacgggagcagatgagtcctatccgatagagggacgcacggtcgttgtgggcggcggaaatgtagcaatcgatgtggcgcgcaccgcgacaagatgcggcgcttcggaagtgtctatgtattgtctggaaggcagggacattatgccggcatccgcagaagaagtagaggaagcagaggaagaaggaatcgcggtgaactgcggctgggggccaaaagaaatattgacgcaggatgggaaggtcactggcatcgtatttaagaaatgcctgtccgtgttcaatgaagaaaagcgctttgctcctgtctatgatgaagaagatacggttacggttccctgcgagcgagtgttcttaagcattggacagagcatccagtggggagaactgctgaatggttccaaagtagaacttggaagaggaaatgcggcggtagcggatccggtgacctatcaaagttccgagccggatatctttgtaggcggcgatgtatacacaggccctaaattcgcgattgacgccattgcggcgggcaaggaaggggccatctccatccacaggtttgtgcagcctcgcagcagccttaccatcggaaggaaccggcgtcagtttatcgaactggataaagagaatatcaagctggacgcctatgacaattcctcgcgccagataccgggaatcgatgaagccattgatcggcgcaagtcatttagggatgcgcgcaagacatttacggaagaacaggtgaagattgagactgcccggtgcctgggctgcggcgcgtctgtcgtggacgagaataaatgtatcggctgcggcgtgtgcacgacaaaatgcgaatttgacgcaatccatctttaccgcgaacatccggaatgcagtaaaatgtaccggtctgaggataagttcaaggcaatcctgccatatgcgatgaagcgggggcttaagatcaagttcggaaggaagagccagtgatagaaaggaacggtagattatgcacgaactgggaatcgtatttcatatcatcgacagcctggaatcggtgggcagggaaaaccagcttacccaggtggcaaatgtaaccctggaaatcggggaagtctcaggcgtagtggattcttatttaaaagactgctggaaatgggcatctgaaaaatcgtctctgctgcggggagccaaactgatcacccaggagattccagcagtgacatattgcgaggactgccatcagacctatggaacggtggagcacggaaaggtatgtccattctgctccggtggaaatacatatctggtggcaggaaacgaatttaatatcaaggaaatagaagcatgctgagaaagagggagggataatcatgctatttcaaatctatggagagaatgccggctggcagctgctgggatggctattggtatttgcgggactgatacttgcgaatgaactggcaagacgtacgaagatgggagggatattctgctttctgatcgtgccggcagcattgaccgtgtacttcattgccatctatgttggcgcggcaaacggcgcggagtgggcgcttaataatcctacctatgtacatatgaacagctggttccactatgcaaaactatacgcggctaccgcgggatgtatcggtttcatgatgctgaagtataagtggaagatcggcaagaccaactggttcaaggtgttcccgtttgtgatcgtggcaatcaatatcctgatcgcagtcgtaagcgactttgagtctggcgtcagaggcgcaatggccctggcagagtatggggaccgctggtggctgtcatccgagaacgtatggctgtatggcggatggtggaactgggtcaacggaatcgccggcatattaaatatcctgtgtatgacaggatggtggggaatctattcctccaaagacaaaaaggatatgctgtggccagatatgacctggtgctttatcatagcctatgacctgtggaacttcgagtatacttataacaaccttccgacccacgcatggtactgcggactggcgcttctgctggctcctacttttgccaacgcgctgtggaacaagggcggatggattcagaaccgtgccaatacgctggcattgtggtgcatgttcgcgcaggtattcccaatgttccaggataccagccggttcgccacgataccgatcctgtattccgatggatttatggatgcggccacaagacctgcggcagctgatccgaccatgcagggcgtagtggcattgctggcactggcagcgaatgtgatctgcctggctgtgattatcaagcggtcaaaacagcagaagaagaacccctataagaacgagatcttcacggatcagaaagatttccagattgcaatggagagagcggaggtataaggggatttttggattggtggacgccggagcggcagaagcgggttttctgcgacgttccggcacctgcggctagtccaccggtatgtaagtctgcagaagagtcgtcataggactcctctcctgcggactaacatatcggggacggatcctccggatgccttcacttaccttcgaaaacccgcttctgccgccccggcttgcgccaatttgctggcaatccgctaggagtgcgggcgttaaggtacactttgcagggagtggattgtggcagaggagcggttgaaagagaggataagagcaggggtttttagttagagattagacaatactgatattttagagataagcctacagcgggagcgatggagtcggttctgctgtaggcttattttattggagttagacaggtcgaggccgcaaaaaaagtttcggcgtaaggtgtgcatgtggggcagcgcgggcgctgaatcgccggtaaattgtcgggagcccgggggtgtctggggaattctggaggtaagcggatgggacgaagaatccgcgcctgagatgttagcctgcaaaagaggagtcagccgacgactctttcgcagggttacagatcagtgcgttagtcgcagtcccaggagcgtcggaagaattccccagacacccccgggcggtcgttaacttgccaagattcctttactcgtaatagatctgccggcttccgctgatgcattcgccaagggaataattaatccactcgatggcgcctttggtgtcccggttgcggatataggtccacatggcatagttgctctcgtagagggactggatgccatagaggtcgcagtagcgctcccacatcgtgaagataggagcccggaaggactggaagattagtggaagcagggtgttctgggatgccagggcgaattcatgctggaattcgaacgcggcctggattgcctcttgattgtctttggcatcccggatctgctcgatgatttccagaagcacctgcacttcctcgtcgctgatacggtcaatacacagttgggcggccagagtgtcaagcgcgattcgcacttcaaagatggagcggatttcttcgttccggatgcggcctccgttgtatttcattatggacatcaaggtgtccaaggttcccttgcgtctgtaatcggccacataggttccgcttcttggctttacgataaggaagcctttcttttccagttcagagatgccgctgtttacgacggcgcggcttacctgcatcatttctgccagctggcgttcgggaggcagtttttcgccaatttttagtttgccggacagaatcatatgttccagctggtctacgaagagttcccgcagagacggagaactgatcttttgaaattccatgaaatcccctcctttgtactggcttgattgtatcatataccattggacggttcaagaaattggaagtatattggcgcaaaccacttatttaagaagtgacagccagacggcgtaaaaatgtaaggacaatgaaaggttccggaaatgtccacgtaaggatggcgtgatagaattttcctagaaagagataggaggatactatgagacgaagaatgattacgatactactaacatccggatgcatgatgttcctggccacaggctgttccaaggctcagatcataaaacagtatgacaatgtgctgcagtccatcggagagaaaagcattacaaagaaccggaagctgcaaggggagcgaaaacttggggaagatagctatgtggggagctataaggcagattatgagtcctttagcggagaagaaatcgtgttcgggggaacaggactttcgcgggatgcgggaaataaaattaaggtctcctgcaagattgaggcggaaaacggcacggcgaagatcaccttccaatcaggaatggaggatgcaagaatattgtgcgatggcataggggaacatacagagacgatagaactgccccctgccagcaactatctgaaaatcgaggggaaagattttaccgggacaatcgaactggacagcgaataggagaaacagaggcatgatctggcagcgggaccaaaaggtaggcgcatcccgaaagccgagattgtggatatgccattgaagatcaagattgtcggacaagaaggactccgggaatgcgtggagggatgccctgggttttcgggacgctttgtccaggccatccactccatcgaagaagtgcggttaacgcagcagaggcaggcttccggtcaatttattaatcttctttttgctgccacatatggcaaggccgatatacttaagatccgtttcggacgtagcggccatcttttctataaattcttcatagacattgcagcactgggcctgttccgtgaagtccaccaccgtcaggtcttcgtaatccgtggtgaatagcttggttcttaagtcgttcagcagttgcgcatttcctttcaggatgggaacaggaaattggatgattccgatatgggagtttccttccttatcggcaacatcccttcctaccacatccggcatcttcatgcccattgtaattccaagaatggcggcggtattggcaattatgcccagcgggagcgcctcgtcgataatcattacgcatttttcgttttccagattcatagctatatcctcatttccattttaaatttcatgcgataaatatcatgcaccattctattttacttggcattagaattcatttcttgtaagatatcttcaattttataaattcatctttaaatgcagaaattttagcaggccctgattatacggggctccctttggcttgcatgttgactttgcgacaggagtgtcttataatacaattacagacacatgtgtcgcaaaaagcgagaaaagaagaggagtttgatatgaacagaaagggaatggagacaaggcagcaaataaaggctaaggcctgccagctgtttgccaaaaaaggatttaaggaagtgacgatgaaggatatctgcgaggctacaggattaagccgtggcgggctgtactgccattataacagtactgcccggatattcgatgagattctgaatgactttatggatacacaggatgaagagtttcgctctaaaatgcaggaagggatgcctgctgtagagatactggacgatgttctggatcgttacagggcagagatgatcgatcgcgaagcatccttgagcgtcgcgattttcgagtactttagcgggagagggaacgcttgcggagaaaatcctctgtaccagcaatacctgtcttcacgaaggatgtgggaggaattgatccagtatggcattgacaggaaggagttttaccaggtagacaagactgcggtatttgatctgatcgtgttttcctatcaaggggtgcggatgtacagccggatcatgaccattacagaggatattccgctgcggatcacgtctcagatcaggaagatcttagtaaggagggaaggataatggcaactgtctttgaaaaatatgatgctgccaggacagcgtttataaatcctggagattgcgtaaaggcaaaggaaaactttccggaagtctgcgtcacgactttttcagagaatattatcgaagattttgccaaaaagaattctgcagaacaaatcgcggagctatacacggcaaacggagtgctgccagtctatggcatcgaatatgcagggataagaatggctttctttctatccagggtaggcgcgccggcctgtgtggcaggactggaagaggtgattgccatgggagcgagaaagatggttatctttggctgctgcggcgttctggatgaggtggcggtgcaagataagatcattattcccagcagtaccatccgagatgaaggaaccagctaccattatcttcccgccggggaggaaatcgggctggaggattcctgcgccggggtattggaggactgcctcttaaagactggaatgccttatgttaaaggaaagatctggacgacggatggaatttaccgggagactcatagacgcttgaaagagaggaaggaacagggatgtattgcggttgagatggaatgttccgctatattggcagtgtgcaggttcagaggtgttccggccatccagtttctatatggagcggatagcctttcgacagacaaatgggagcccagggatctgatggaatatggaatcagggaatgcgacagatatatggcccttgcgctggaatgcggggctagattgtagccggagcctcctgatatccaggaaaataaagaataatcataaaatccaaagagaatctttcagatatgttaagaattactccaaggaaatctttagaattggcgagtaagataaggacaaagatgaagaaagaatgggggaaggaacatgaacgtacttatactcagcagtcaattcgggatgggccatcagatggcagcaaaggcaattggagaagagattcttaagttggataaagatgcaaatgttatagaacttgatttattaagatattattatccaaaggcaagccgatacattttccggctgttccagatgatggtggaacattgctatgggatatataatctggtatataagacaaccggaaaattgaaggtagatctgaagcctatgggcattaatctctacaggaaactggaaaaattgatggaggatcatcatccggacatgatcgtatgcaccttgccgctgtgtgccaagtcgattgcctcgtatatggaaaagaccgggaagcatattccgctggtcacctgcattacggatatcagcatccatccggagtggatcacgcctcagacggatgcctatctggcgccgacgaaagaggtcaaggagaatctggtacgcaatggcgcacgcccggagcagatattcgttacaggaattccggtcaggcagcaattcctgggagaagtgccgaaacgggataaggagcagaaaaagatactcataatgggaggagggcttggaattatcccgaatctggatcagctgatgcagatgctccaccgtatgcctggcatcacagcaaccgttataaccgggaaaaaccgaaaggcttatgaagcgttccaggggaaatatgaagatattgaagcacttggatacacggagaatatcagcaaatatatgaaagaagcagaccttgtaataacaaaagcgggaggaattacgctctttgagcggatccattgccaggtgcctctgttcgtcatccaccccttccttgagcaggaagtgaacaatgcaagatacgcccagaatatggggattgcaaaggttatatggaataaaaacagtaattttctccaaatattagaggaattcttatccgatggaagacaatgggagcagatggcggagaatataagcagggcaaaagacgagattatggaatggaacctggatgatgcgatgaatacggtgatggaaaggatggcggcataatgaagaaaatgatattgatggctgcattagcgggcgcgttaggctacagcatcctcccatcattcggactcaggcattatcagagcctgcgccgcaggaagaacaatgaaggcaagattctctttctgacctttgatgacgggccaagcgaggcatatacggaggctttgcttgacctgcttgatgaatatgatatcaaggcatccttctttgtagtggcagaatttgcgcagaagaatccgcggatcatcctgagggccaaaaaggaaggccaccttattggcattcattctgtgaatcatcagaacgcgctttttcgggggaatagatttgccttttctgacctggcagcatccattctgactttgaagaaattaggatgcgaagcaagatattaccgtccgccgtggggccacctgaatctattcattctgcactgggtaaagaagatgaatctgaaacttgtattttgggatgttatggcccaggactgggcagcggacgccacgccggcatccatccgcacgaagctgcttcggcgcgtttatccgggcgccgtcatctgcctgcatgatggaagaggcgccacgggagcgcctggaaggaccatagaagcattgagagacgcgcttccccaattgctgcgggaagggtatgaatttaagaggctagaccaatatgaatgatacgatatcaataaaaaagacaggaaaacagatactggtatttctcttttttctttttttgatttttttctttctttttaaaggaaaagacgtaagccagatacttaagatcgccgcttctgcttcctttcctgctattgtggcaggaattgccatggctggagcctttaacctctcagaaggcttgaatcttggcattctgctaaaggcgatgggccataaggtgtcttttgcccaagggatgaagtatgcctatatgggattctttttcagttccatcactccttcgtctacagggggacagccgatgcagctctatgcgatgaaaaaggatggaatagacctgtcccatggctcgctggcacttttgatggaacttgccagcttccaggccatggcgttcttgtttgaactattcgcggtggctatgattcctgtgctggggataagcctgccagcgacgatcaagatcctggtcgttgccggatttatcatgaacgcggcttttgtcgctttcctgctggtggtgattttctcggaacggatggggcaaaggatattcggcctggtaaaaaagatcttgccgcgactcccatttgtgaaggaagagaccaagagccaatggattaggaaaatggaagaggggcttctggaattccatgcctgcgccctattgatgaaggaacataagaaggccatcgcaaagatgtgcattatcagcgcaggccagattatctgctggtttggcgtgccgtatatggtgtatctggcgctggggtatcaggggagttccttcctccatatctttgtactgcagattctgatctatatgtcctcgtcccttctgccgctgccgggagccatgggcatcagcgaatatgccttccttcagctgttcggaagcatttacagtggcagttccatgacggcggcggttcttttaagccgggggatcagtttctacttcctgcttgcattgagcggcatcatgctgcttctcatctacggcgctgcgcggcagcgcaaatgtaatactattttttcctgatttttctatactttaagcaagccatggggtataatgggaaaataagattttaaacagagaggttagagacagaatgagcaggaatgatagagatacgaatgtaaaacaggatacgatggagaaaatgcgtaattctgaagcagtctatgtgattttatcggattatacgcatatgccatatgtggcttgcgatcctaagacttttgatgaccaggtgttcttatattttaaagaggacgatgccaaagaagcggtgagaagatttgccgggaaccaggagagtacccgtgcggcaaaacttgagaagaatgggttccttgcattttatacgaatcttttcgcgatgggagtgaactgtatcaagatgaaccaggggaccagccaggaagtggatgtccagctgggagaactggtgagaaggccggaggcggacaaattgccgcaagggcaggtgaggatcgagaatccggaacttcatctgactgccctgtattatatgcaggaactgcgaaaaagccaggatggaggaaccgatcaattaaaggaattgaatgaggaattaatgattcatttcaaagagggcagatatatcgtcgcggtgcaggagggacagggaatcccgatgctgcagaaagaggggaagatataccagccattattcactgacttccaggaattccagaagtttaacagggagaagaagttcaagacagcaatcgtagaagccggcaagataacagaattcctttcatcacaggcggttggcgtagtcattaatccgatgggcgtaaaccttctgctgaacattgcaagataaggaaatggcaatgcaaacaagagcgaggaggaaaagcgtatgacagagtggtcattggtgacggaagttattgcgctgctactgctggaaatacttctgatgaatcttgccgcatataaaaccccagcgacccactctataagaatgtacagaaactgcctgtttatatcggtaggcacggttctgtgcgatatgctatgtatcgtcctcctgcatggaggatttttggttcctaaagtagtgaatatatttaccaactcggtatacttctggcttactgttatcatgagttcatccatagcactctatatatttgaaaagatgctggagcatgtgtatgaccgttactgtatcgtgcgtgcgcgagtgctgctgacgatcctggtgatcgtctatacgatgcttgtgatcatcaatgtgcctgccgggctgctcttttggcttgacgggaagggggcttatcacagagggcctttgaatacggtgggctatggattcgtatttattgaaatgatattggtatttatatgttttgcaaggcaccgctccagcgtatcgaaggagatgaagcatgcgcttaagacgattcctccgctgctggctattctggttgcgattcagctattgaatcagggcctgctgctgaacggcattatggctgctgttgtggatgtaatcttgtatgtcagcttcttcagccagcgccgcgaaagcgacagcgtgacaggcgtaggcaaccgggatggattcttttcagaactagcgctgcggattgccggaaagcagcaattccaggtgattctggccattccaagggattttggactgatcaatcaaagatatggccatcagataggaaatgaattcttatattccattgcagcatggatggaagaacattataaggaagcggcagccttccggtacataggagtttcatttgcgctggtgcttccctatagcgggagggagcaggcggaaaagtatgtgaaagaattaatggaccggttccaggagccctggaagattggcccttgcgaagagagcataactacggtattcagcgatctgatctgtatggaagacgatctgggcgagaatcaggttatggaattcctcgattatatgctctcgctgaccaagcgctcgacgcagcagtatatgcattttgacgacgctttggcggaaggcttcttccgaagaagaatggttgcacagactgtacgcggggcattgagggagcagctgttcgaagtatggtatcagccggtctatgcgccgggcaaaaagaaatacgtatctcttgaggcgctggtgcggctgaaggataggaatggatgcttcatttctccggccgaattcattccaatcgcggaggaaataggagtcgtcaatgagattttctggctggtaatagaagaagtgttcggctttttaaaagaacacgaagatctggatatcgagactatatccatcaatatgtctatggaacagtttgataatccgcagttatgccagagtatagaagcgatatttaagaaatggatgatctctccggaaaagatccggtttgagataacggaacgcatgatatcggaagacgcggtcaaagcaaaagagacggtgcagcagatggcggacttaggattctggttctatctggatgactttggtattggatactctaattttgcgaccgtttctcagtttcactttgaatgcattaagcttgatagaagcctggtggatgtaatggaggaaggccctaaaggatttgacctggtacggggattgatccagctattccacaatatgggcatgcaggtcgtggccgaaggcgcggaaacataccggcaggcggatatgctgatcgggatgggggcagaccggatccagggattctattacgccaggccgatgccggcggacaagctgatagagttcttaaaaagagagcaatagcccggacagggcgcgggatatgaaaaggccaggcagcgtatcgctccctggcctttgccataatctcatttcgtgtagttcttttaaatatctaaatcaaatcttgctttatatatataaaaggtacaactaaattccgattagtgctttgaaattaaagtcttgttacgttaactgcctgaggtccttttgctccttcagttacatcgtattctacttcctgtccttcttccagtgacttgaagccatccatgttaagtcctgagtagtgtacgaatacgtcgtttccagcctcatcagagatgaaaccgtagcctttttggttgttgaaccattttactgtacctttcattacgatacctccataaaaataaaaaataaataattagataccgcattatccataaaactcatctatagataataccccgtcagattagcatatatttataaaaaagtcaatggagttgacaatatttttattatttttcacaaaaaactggacatgagaattgccttgggccactttttcagatacaatgaatattaagaacaattaggaaagaaatgagaggcctatgaaaatatcgacaaagggaatctacgcattggagatcattacggacctggccatgcatacagagaatggagcgctggaaagcatcggcaatattgccaggagaagagggctttcagtcaaatactccgaacgcctgatcaaggaactgaaggatcaaggcctggtgatcagcctaagaggcgcccatgggggttactgcctgggaagggatgccggggagataacggtcagggaagtgctgcaggctgaagaaggagaactggcgcctgtggagtgcctgacgaaggagactacttgcggaatcgactgcaatacctgtgccacccgggagatatggagccagatatggcagatcattctcgatacggcacaggaggtgacgatcggggatattatcgaaaagtcaaaaagtttgagataagtattgacatatggaaaaaataggtgtataaaataactcatataaaacctattggtttagtaggatatagaggaggaagcatgaagatatcaacgaaaggaagatatggccttcgggcattggctgatcttgcggcatattcgcagggcgagcctatcgcgcttgctatggtggctgcccgccagaagatatcgctgaattatctggagcaagtattcggacagcttcggaaggctggactggtgcgaagcatcaaagggcccagcggaggatatctgctggcaaagccggcaaaagatattacggtgaaggagatactggaagtcctggaggggccattctccatcgtgggagaagatatagacagaagcggacaggatgccatgcagctggcgatcaagagcctggtgtgggatgagatcgacgcccggatcaatgagttcatggagaagcgtacgctggaacatctggtaaacgagtataaaagctatcaggagagtcaggatatgatgtactatatctgatatttttagaaagttaaatcctactatactgataagtaatatatgttatgaaaattataaagaaagaaggacaacgatatgagccagagaaaagaattgagatttgaaacgttacagctgcatgtagggcaggaacagccggatccggcaacagatgcaagggcagttccgatctatcagactacgtcctatgtattccgcgactgccagcatgccgcggacagattcggacttgcggatgcaggcaatatatatggaaggctgaccaattccacgcaagacgtgttcgagaagcggatggcggctttggaaggcggggcagcagctcttggagttgcctcaggagcggcggccatcacttatacattccagaatctggcacagacaggagatcatatcgtggccagcaagtacatatatggcggttcctataatcttctggaacatacgcttccaacccaggggattgccactacattcatagatccggacgaagagggcgcgtgggaggctgcgatccaggagaataccaaggcattgttcgtggaatccatcggcaatcctggcgctaatctggtggatcttgagaaggtggcagagattgcccacaggcacggcatcgtactggtcgtggacagcacgtttgctacgccataccttctgcgcccgtttgcgtatggggcggacatcgtggtacattccgccaccaagtttatcggaggccatggcacggctcttggcggcgtcattatcgatggcggccgtttcgactgggaggcatccgggaagtatccgcagctgactgagccggatcccagctatcatggcgtgatatttaccaaagcggcaggggaggcggcatttgtgaccagaatccgcgcggtgctgctaagggatatgggagcgaccatcgcgccgcttcatgcgtttttattcctgcaagggatagaaaccttgtctcttagggtggagcgccatgtacaaaatgcattaaaagtagtagaatatcttgagaagcatcccaaggtagagcgggtgaaccatccggcgctgccaggcagcagatatcatggcttgtatcagagatattttccaaagggaggcgcatccatctttactttcgagatcaagggcggggaggaagaggccagaagattcatcgatcacttgcagatattctctctgcttgccaatgtggctgatgtgaaatccctggtgatccatccggccagtaccacccattcccagatgacggagggagaactaaaagcctcggggattcaaaagaatacaatacgcctttccatcggaacagagcatattgatgacattattgaggatcttgaacaggcatttcaggcagtatagacggtgatggaacgcatatcatggaagaaggacgatttattatattaatatggaggagacagacatgggaaaaatatatcagaatgtagaagcattaattggaaagacgcctctaatggaggtgtcgaggattgaagaggaggaaaaactaaaagccaggatctacgcaaaactggaactattcaatccggcgggaagcgtgaaggacagagtagcgttctccatgatcctggatgcggaggagaaggggctgatcggccccggagcgacgatcattgagccaaccagcggcaataccggtatcggcctggctgccatagccgcgtcaagaggatacaaggccatattcaccatgccggagacgatgagcattgagagaaggaaactcttaaagggctatggagccgagattgtgctaacggacggcaaggctggcatgacaggagcgataaagaaggcagaggaactggcaggcgagatggacaatgccattgtcttgggccagtttgtgaatgaatccaaccccagagcgcacatcaatactaccgggccggagatctgggaggatacggagggaaaggtagatatatttgtggctggcgtaggaacgggggggacgattacaggaaccggcagatacctcaaggaaaagaatccgctgatccaggtagtggcagtagagccaaccgattctcccgtactctcgggcggcaagccagggcctcatggcctgcaggggatcggtgcgggattcgtgccagagattctggatacggatatctatgatgagatcttaaaggtggagaatgaggaggcctatcaggctgcccgcctgatcgcaaggaagcaggggattctggtggggatctcttcaggggccgcgcttcacgctgcgatccagctggcgaagaggccgcagaacgcaggaaagaccatcgtcgcgctgcttccggacacgggcgagagatacctttcaaccccgctgtttgactaatcatttctcttgacgaaacgcccgtaagcgtgtaaagtatatagtgctaattaccaataaaagatacgaatgaaacagtagagggtataaggtatgattacactgacggggaaaaaggtgtccgagggcatagccatcgggaaactgactttttacaagagagatacaaaggaaaatcgccgcatctatgtaaaggatgtggagaaagaggtcatgcgtttccagaaggcccggcagaaggcaatattggaattgaagattctctatgacacagcggcgaaggaagtgggagaagccaatgccgccatttttgagatgcagcaggcaatcctggaagaccaggattttatagatcagattacgaatatcatcgcaacccagaagctgaatgcagaatatgccgtccaaagcgtagcggaaggctttatatcagatgcggtagcgaaggagaaagactatgtgcaaggacacgatgcagacgtgaaagatgtggcaaaccgtgtccttcgcattctgtccagaggctggaaggacaagatgctgacggatgagccttttgtactggcggcgggcgaactgtacccgagcgaggcagtgcagctggataagaccaaggtgctgggattcgctacgcggtatggaacgatcaattcccatacggcggtactggcgcgcacgaaaggaatcccctctgtcatcggacttggggaggcgcttaagaaagattacgaaggcaagacgatcatcgttgacggttttgaaggcaaggtttatattgagcctgattatactacgattaccaggatgaagcagaagcaggatgagaagcacactcatgtgaagaacctggagcgtctgaagggaaaggacaatattacccagagcggacagaggattgatgtctgcgccaatattggaagccgggaagacgtagagaatgttatccgctgcgacgcaggcggaattggactgttcaggagcgaatttttgtatatggagaacggggccaagcctccgacagaggaacagcagttccaggcttacaaactggcggcggaatccatgggcgcgaaaaaggtggttatccgtactgccgaccttggaggagacaaagtggcggaatgcctggatctgggcgaggatgacaatccggccatagggtatcgtggaatccgcgtctccctggataaggaagaactattcaagacccagctgcgggcaattctgcgggcatccgcattcgggaatctgtcgatcatgtttccgatgataacatccattgaagaagtgacacatgccaaagtcatgctggaaagagccaagagagaattaaaggatgaaaaaacttcctttgatgaggagatccctgtaggcgttatgatcgagactccggcggctgtcatgataagcggagaattagccagagaggttgatttcttcagtattggaaccaacgatctgtcccagcttactctggggatggacaggcagaacagaaggcttgataagttctatgatcctcgtcatccggcattgcttaagatgattcggattattgccaataatgttcatctggaaggcaagcatatcagcatctgcggagatctggcagcagatttggaactgacggaatattttatccagataggaatcgacgaactgtcggtagctccgaaccaagtactgagccttcgcaagaagatcagagaaattcagtaatttcagataagatgatatagaataagaataagaatcaccatgatatcacatgataatcatggtgatttttcttttgcgccagctgtctattgtgcataatttttgccggtgtgatttggtgattatttttgactgaatatgattgactttgactgaaagtgattgtatcataaggataaaggtgaacgaaattgaatgaagttgaacgaatatgactgagggagggacaggagatgctggcagaagaacgctacaatgagatattaaggcttgtaaatgagaaaaagacggttaccgtacaggaattgacggaggtgcttgatacttccgaatcgacgatccgcagagatctgaccacgcttcataagaagggaagcctgatcaaagtgcacggaggggccacggctcttagcgtggaaggaatgaccagggacgcatccctcactgttcgcagagatatgaatatagaggaaaaggtagcaatcgcgaagtatgcggcagctctgattgaaaaggatgattttgtctatctggatgcgggaagcagcgtagatctgatgatcgactatatcgtagagcaggaagccatctatgtcaccaacgcgattggccatgcgcagaaattgttgcagaaagggtgcagggtctttctgctgggcggcgagttaaaagaagtgacagaggcaatcgtaggcgcacaggcgatcgacagcctgaaaagatataactttacaaaaggctttttcggggctaacggagtacatagggagcgcggcctgacgacgccggatattacagaagcgctggtgaaggaaaaggcaatggaacagtgcgcgaaccgctatgtactggcggattctaccaagatcaaccagatctcttcggtgaccttcgccggatttgaggaaggaatgatcctgactaccaggctgcgggatgcgtcctacaaggcatgcaagaatatattggaggttggataaaacatgatttatacggtaacatttaacccttccctggattacgtcatccagacggaagaactggtgcccggcaggattaaccggaccacccatgaatgcatctacccgggaggaaagggaaacaatgtatcagtgatactgtcaaacctgggactaaagagcaaggcccttgggttcgtggccggctttaccggcgaagcccttgagaagatgctcaatgattatgggtgctacacggattttatcaaattaaaagaaggatttacgcggatcaatgtaaaagtcaatgcaaaggaagagacggagatcaatggacagggcccggtgattaccaatgaggcgatcgatcttttgtatgagaagctggatcagctggaggaaggggatgtactggtgcttgcgggaagcattcccaatacgctgccctcggatatgtatgagcggatcatggaaagacttgaaggcaggaatatccgggtggcggtagatgccacaaaggaactgctgctaaatgtgctaaaataccatcctttcctgataaagcccaacaatcatgaactgggcgagatgtttggaactaccattgagacgcaggaagagatcatcgaatatgcgggaagactaaaggagatgggggccaggaatgtgctggtgtcaatggccggtgacggcgcgcttctcctggcggaggacggaagcattcatagcgggaagcctcccaaaggcaaggtactcaattccgtaggggcaggcgattctatggtggcgggatttttaaccggatacctgaataccggagattatgaaaaggcgttcagactgggagtcgcaaccggaagtgcaacggcatttctttattggctggcagccaaagaggatgtagcgaggctgcttaatgaggatccaaaggaatatggattataggagggaaaaagagatgaaaattgtagacttgctcaggaaagagagcattaacctaaatggagaggtccgctcaaagaaggagaccattgaccagatggtagatcttatggctgcgggaggcaacattgcggacgtggatatatacagagaaggcgtatataaaagagaagaggaaggtaccacggggattggggaaggaatcgcgatcccgcacgccaagactgatgccgtcaaggcaccggggctagcggccatggtggtgaaggaaggcgtggactatgattctctggatggagagccggttcatttgatcttcctgattgccgcgccgaatacagaagacaatgttcatctggaagtattgagcaggctttccatgctgctgatggatgacggattccgtgagaatcttatgagtgccgggacaaaggaggaattcctgggctatatcgacgccgcggaaaaagagaagttccccgaagaatccaaagagcagaaggaaaatgataaagaggataaaaaaggctatcagattctggcagtcaccgcgtgcccgaccggtatcgcccatacctatatggcggccgaaagcctggagaacaaggcgaaagagatgggctacacgatcaaagtcgagaccaacgggtcaggcggggataaaaatgtgctgacagccgatgagatcgccggatgcgactgcatcatcatcgctgcggataaggatgtaaagatggcaagattcgatggcaagccagtcattattacgaaggttgctaacggaatcagcaaagccgaagaactgattacggaagccatgagcggcaaggcgccaatctatcgcagcaaaggcacggatgaggcggcgttaagccaggacggggaaggcctgggaagaaagatctacaaaagcctgatgaacggcgtatcccatatgcttccattcgtgatcggcggcggcatcctgatcgccctgtccttcctggtggacagcgccaatgcgggagccgcggactttggatccgggacgccgcttgcgttgttcttccatacggtgggcaatactgcgtttggcatgatgttcccaatcctggccggatatatcgcgatggcaattgcggacaggccggcgctgatgcccggtatcgtgggcggattacttgccaaggcaggaacatccgtattcctgccggaagaccagtgggtatcttccggcttcttcggagcgctgattgccggcttcgttgcaggctacctgatggtgctgattaagaaactgctagataagctgcccaaatccctggaaggcaccaagccggtactgctgtatcctttccttggcatcctggcaatgggggcgattatgatattccttgtaaaccctccggtaggagcctttaatacctggctgaatgatatgctggcaggcatgggagaatccagcaagatcctgctgggagccgtcttaggcgggatgatgtccattgacttcggaggaccattcaacaaggcggcctacgtgttcggaacagcggccattgcaagcggccagattgacatcatggcagcagtcatgatcgggggcatgacgccgccaatcggcatcgcgctggcgactaccttctttaaaaaccggtttaccaagagtgagaagcagaccacggttacgaactatatcatgggtctatcctttattacggaaggggccattccttttgccgcatccgatccgctaagaatcatacctccatgcgtagtgggctctgcagtggcaggggcattgtccatggcatttggatgtggttcaagagctcctcacggaggaatcttcgttatcgggatcgtggagaatgcgccgatgtttcttctggcgctggcaatcggggccgtggtaaccatggcaggaattatacttttgaaaaaaccgcttcctgtagaaaaacaatagacagcgaaaataaaaataattataataaagaagaggagaatgaaacgatgaaagaattccagtacaccattacggacccggagggaatccatgcaagaccagctggcctgctggttaagaaggccaacgaatttacatccaagattatgattggaaagggcggcaaaagcgcggatgccaagagaatctttggagttatgggccttggagccaaaaaaggcgacgagatattcatgacggcagaaggcgcggatgaggatacggcggcccaggcactggaaacatttttaaaagagaacctgtaaaaggggatgatgaaaagatgattacactaacaggaaaaagcgtatttggcggagtcgcaatcggcaagattgcattttacaaacgaaatgagattacgatcaaaaggattcatgtggatgataccgaaggggaagtaaagagattcgagacggcgaaggaaaaggcagtggcccagcttcaggaattatatgataaggcgatggaggacgtgggcgaatccaatgccatgatattcgagatccatcagatgatgctggaggacctggactatgtagagtctatcgtaaatatcattaccacccaggaagtgaatgccgaatatgctattggcaccacggcagataactttgcagccatgttccaggctatggatgatgcatatatgcaaggacgggcagccgatgtaaaggatgtatccgaacggcttcttcaggtgctgtccgataacagcaccgatgcaatgaagatggatgagccggcgatcatcgctgcggatgacctggttccaagcgagacggtacagctggataaagagaaagtactgtccttcatcaccatgcatggatctgccaattcacatactgccattcttgcaaggacgatgaacataccagcagtgatttctcttggagaagacctgaaaaaggagtatgacgggaaacttgccattgttgacggactggaaggaaaggtctacatcgagccggatgcaaagaccatggaggccatgcaggaaaagcagaggaaggaccaggagcagaaggaacttctggagcagttaaaaggcaaggagaacataacaaagagcggacagaaggtaaatctgtacgcgaatatcggaaaccttgccgatgtaggcgctgttctcaaaaatgacgctggcggcatcgggctgtttcgaagcgagttcctctatctggaaagcgagacgtatccgacagaagaacagcaattttccgtatataagacggtggcggagaatatggccggcagaaaggtcattatccgaaccctggatatcggcgctgacaagcaggtggattactttgggctttgcaaggaagagaatccggccatgggataccgggcaatccgtatctgccttacaaggccggagatattcaagacccagcttagggcattgtaccgggcatccgcattcggacagatcgcgatcatgtttcctatgatcatatcggtcaatgaagtgcgaagaatcaaggaaatcattgaggaagtgaagaaggaactgacggaagaagggattgccttccgggaggatgtagaactgggcgtcatgatcgagacgccggcggcagtcatggtgagccgggaactggcaaaggaggttgatttcttcagtgtcggaaccaacgacctgacgcagtatacgctggcgatcgaccgccagaaccagcaattggacgcattctacgactcccatcaccccgcggtcctggagatgatccgcatggcagcggcgaatgcccatgcagaaggaaaatggattggcatctgcggggaactggcggcggacttaagccttacggagacattccttgagatgaagattgacgagctttccgtggcgcctggcatggtgctgccacttagaaaacggatcagggaagtccggtaatagttattgataacaataattaatagatagacccatttactttatgggtctattttgttaatattaacttgttattgtttctaatgatgagagacgaaaaggagggaaacacatgttagaaaagttttttaaactgagtgagaatggcacggatgtaaagactgagatcctggccggaatcacgacatttatgacaatggcctatatccttgctgttaatcccagcattctttccgctacaggaatggatcagggagccgtatttactgctacggcgctggcatctttgattggcacattgctgatggcattatttgcgaattatccgtttgcactggctccgggcatgggactgaatgcttactttgcatacacggttgtcctgggaatgggatacagctgggaggttgcgcttaccgccgtattcgtggaaggtattatatttatcatcctttcgcttaccaacgtgcgtgaagcgatcttcaatgcgattccgaagaacttaaaggctgctgtcagcgtaggtattggtctgtttatcgcatttatcggcctgcagaacgcaaagatcgttatcggaggctccacgcttctccaactgttctctgtggacaagtacaatgaggcaaatggagtggcagcatcctttaatgatgtaggaatcacggtacttcttgcgattattggcattatcattaccggaatccttgtaatcaagaacatcaaaggcaatatcctgtggggcatcctgattacttggctgcttggaatcatctgccagtttgccggcttatacgttccaaatccggaacttggattctacgggctgcttcctgatttcagcagcggactgtcagtgccaagccttgcgccgatattctgcaagcttgactttacaggaatcttctcattgaactttattgttgtaatctttgcattcctgtttgttgatatgtttgacaccattggaacattgatcggcgtatcatccaaggcaaatatgctggatgaaaacggcaagctgccacgtatcaaaggcgcgcttcttgcagatgcggttggtacgacggcaggcgcactgcttggtacttctactaccacgacattcgtagagagtgcatccggcgtatcagaaggcggaagaacaggccttacggcagtgactacggcgatcctgtttgggcttgccctgttcctgtcgccaatcttcctcgcgattccttctttcgcgacagcgccggctctggtagtcgtaggattctatatgctgactaacgttgtcaacatcgactttggcgatatcgcagaagcgcttccgtgctatatctgtattctggcaatgccattcttctacagcatttcagaaggtatctccatgggagtcatctcttatgtagccttgaatcttttgacaggaaaggctaaggagaagaagatcagcatactgatgtatgtgctggcagtattatttatattgaaatatatattcctgtaaaatataatgggaataggagatttgaacgacaagggaccggaatttccggtcccttttttaaaaggaggtaagggaatggacagaaagtatatggagataccggtggtaaagcagatcgcggaggcagaagaagtaggatgggtgaatccgaaatggaggccatggaatgaggcaaaggatagccttggcatttcgatggaggatattgatgacgcagaggcgagacttttacgctttgctccctttataatgaagtgcttcccagagacggcggagcgaaatgggctgattgaatccgccctgacaccgataccgaagatgcaggaatttctgaaccagacgtatggagatccgattcagggacgtctcctactaaagcaggacagccacctggcagtggctggctctgtgaaggcaaggggagggatatacgaagtgctgaagcatacggaagacctggctttggaagcagggcttatcacgcttgaagatgactattccaaactggcaacggatgaatccagggaattcttcagccagtataccatacaagtaggttctaccggcaacctgggcctgagcattggcatcgccagcgcggcggtgggatatgaagtcatcgtgcatatgtctgcggatgcaaagcaatggaagaaggatatgctgcgaagccatggagtaaaagtggtggaatatgagtcagattacagcgaggcagtaaagaatggcagaaaagaatcagacgccaatccgaagagctactttgtggatgatgagaattccaagaatctattcatgggatatgcagtagccgcaaagcgcctgatcggacagatggaagaactgggcatccaggtggatgaagagcatccattgtttgtctatattccctgcggcgtaggcggggctccgggcggcgtgacgtttggcctgaaggagatatggggggatcatgtgcatgtgttctttgtagagcccacccaggctccttgcatgatccttggaatggcgaccgggctccacaatcagatctgcgtgcaggatgtagggcttaccgggctcacccatgcagacggcctggcggtggggcgtccgtcgggattcgtgggaaaggttatggagcctctgctaagcggcgaatttacgctgaaggatcaatggctctatgagtatatgagagctttatgggatacggagaacatcttcatcgagccaagttcctgcgcggcatttgagggaccgctgaaacttatgcgttatgatgagactcggaagtatatcaaggaacatggcctggaggacaagatggagcagtctgtccatatcgcgtgggcgaccggaggaaaactggttccggaagatatccgtgaagagtataagaatacatatctggactaggacagaaggcaggaggagaaaaaatggaattcagtcattttgatgaggatggcaatgcggtaatggtagatgtctccggcaaagaaatcacgcaaaggagagccctggcggagggaaagatccgggtaagccgggaagtgtttgaagccatcgccggcaggaaggtgaagaagggcgatgtgctgacggtagcccaagtggcagggattatgggaacgaagaggacggcggaactgattcctatgtgccatctgctgaatcttaccaactcggaagtcaggttcgagatgaaccccgaagaacttgagatcaaggccttctgccaggttaagacggaaggaaagacaggggtggagatggaggcgctgaccggcgtgtcgacggcgcttctgaccatatatgacatgtgcaaggccattgacaagcggatggtgatcgaagagatccatctctgtgaaaagagcggcggcaaaagcggaacatttatgtttgaaaagtagaggagaacgggatatggcggcagacagggtagaaaaactattaaagaagcaggcattccaatatgagatcagggactgcgagcgggatttcgagagcacggaagattccatggagctgctccatatcccggcggaaaagattgcaaagacgctggcctttgctgcgcctatcggggctaatataatcatattgtcaggggatgccagaatcgacaatgcaaagtacgagaaatgcttcaaagttaagcgcatcgtgctggatgaggaggacctgttggactatacgggctgcaggcctggctccgttagccctatcgctcttcccaataagcgggcaaaggtctatatggacatttccctgcaaagatatatggatgaatatgtatatacatccggcggcacaggaaacagcgccatcggcatctgcagcagagatctgtaccaagtgaccgcatgcaagggctgggtagatataggtacaggctggaagaaagaaatggcagatgaagaagaatagtcttcccctagagccggatcagcatggttaccgtgaaggtatcctccgtgtaggagatatccagcgtgccattatatcgatctatgatttcacgtatatttcggatgccgagtccatgggacttggcatcttttttgtctgacaggatatggccgtttttctccacgatggggtttgccttctggttcgagatctcatagctgaagtagccggaatccgtggaacgggcctttacggagatctttcttgcgacaggctctctgatcttcagggaagcctctatggcattgtccagagtattggagaacaaggagcagaggctgacagagtcgatgctctgtatattatggagatcgacatggaagaagcagtcaatgccttgcccgactgcctggctgtatttggcattaagaacggcattgacgatgctgttcttgcagaatacccggttttgcacggcaatctgggactctacttctttaaaatattcttcggcttccattctgttttcggaataaaaaagatcctttatcacacttaagtgatgattcatgtcatggcgtaacttacggatctccgtctgattgcgttccagttcttcataatattcctgctgcagcttcaggttattccgctctgcctcaaggcggatgctgttggaaaaatatccggccaggcagaggcttcctatgttggtaatgatgcaggccagggcgcatagccagatcttgtagctttgtgccggcgcatagtagatgacggtagtgatgctgaccagcgaagccagacagaccgtgcccagcaagatccaggtgttctggtcgaagagcctgctgaaatcataaagtctctggtggaaaagcctatacagcacataccagaagaggatatgcaggaatgcatctgacaaataacagaatatgcttgcaaaaagtgtggcatctaaagataaatatactacacccaacagatcctggatgagaaaatttaatgagatgaccagcggataaaagattgccaccgacgcaagcttgggtaaggctcttcctttgaacgcaaccagcatcagcgcggtaaaccacagaagatctaaggtcacattgaacatatcgttggtaaagatggtcattccaaagagaaagtagcaggatacgcctatgacggcggtccagaactttccgtcctttcttggaactacagagtacagcagtctgcagaaaaaaggaagcccaaaggcgtacaggcatttggaaaagacttctattattgtggatacggactcttgattttgcatttttttcctcccttattggagcagcgcccgggcaaaggcgatctccaattgctgtctgtaagtcctgctgacaggcaggaaatgatccccgcacacgcatccgtcaggttccagggctgtgatgtggttgaggtttgccagatatcggttatgaattcgaatgaaatagtccggcagctgcttttctacttctcccagttttccataaaagtccagtttcccatctgctgttaagatggagatctttcttcggtcgctgcaaaaggccaggatctgttttaatgggactctcaagatgccggatttctgctcaaccgtatagaactgctcgcccagattgccaagcagttttaatgcctgttctaacacctccaggattttccggtcttcgtaaggcttcaggatatagtggaatgcatggacgtcatagccctggaatacaaagtcagggtaagcggtcacgaagatcaggatggtgtcggactccatccgccttaaggagcgcgcagtctccatgccatttagtccatccatctcaatatccagaaagaggatatcaagtccatccgtctgggagcctgcgagcaatgcctcgccggaagcatattccaggatgcggtattcttcccccagtagctgaagcttcctttcaagcgggactctcaatgccttttgcatctttgggtcgtcatcgcatattccgatcgtgatcatatttccaccgtctccttatcatgcctctgccgtcaggcagaaggcttctaaacgatattatacagaaatatccgggttttgcaaactttacagaaaccatgtcaaacttgacatcctgaaggaagatatccttgctctcttcttctagaatagaaggcagaaagaagaagggagcaatcattatgttaaaagtagagcatttaaccaaaagctatcagaccggaagccaggtatatccggtccttaaggatatatcgctggaagtggaaaaaggagagttcgtggctgtcatggggccttccggcagcggtaagactacgcttttaaactgcatttcctgctttattccttacgaagacgggagcatcctgctggcaggcaaggatctgtcagggcttaaggaggaagggcttgcaaaggtccgtaatcagagcatggggtttgtgttccaggactttatgctgctggacggcttgagcgtattcgagaatatctgcctgccccagatcattgcgaagcggccgattcctcagatggaggcaaaggccaggcatatctgcagcctgttcggtattgaaaaaattatggagaagtatccggcggatatctcaggcggggagaagcagaggacagctgtcgcaagggccctgatgaaccagccctacgtgattctggccgatgagcctgccggcaatctggacagcaagtcctgcaaggcagtgattgatgcatttctccaggccagatcagagatggacgccaccatattcatggtgacccatgacagttatgcggcatccttctgtgaccgggtgatcgtgcttaaggatggcaaggtccatggcgagttgaaaagaactggtaccagaagagcgttcatggatgaactgctgaacaccataagggaactgggaggggattcggatgacgatgaataagattctagagaaattgcggaaggagaataaggaccagtacaggattcttggcatctgcatcttcctgtccatccttctggtatcttcttacgctatgatgtatttttcgcccgccatccaaaagatgctgccggagggaggcgatacgagaaaactatgctggctgatgttcggcgtgacggtagccggctgtaccatattcacgatatacggatcgagtttgttttttaaatacaaaagcagggaattcggagtgcttctggcgctgggagagcggaagaagcagctggccggctgcctggcaagagaactcgccgctgtgatcctgggctatatgctgctgggcattatcggcgccttccctatatccttccttatctggaagggattccaggccttgctccttgatgcccggaatcttaggtacagtatcagtatgatgggaatcgccgcgggcgtcctttttgcctgtctgcttgcttgctgcatatttgccgccggataccgttttatcaggcgggcagatattatggagattctgaaaacccagcgaaagagcgagatcgtaaaagatatcaggccatggacaggaaaactaggcctggcctgcgtaataataggcctggcgcttgcgatggccgtgccgccgatatgggccagggtgtttcatcatcaagcatccccgctttggaatggagcctatctgatcagcgccgcgggcctatatctattcctcctaagcgcggtaggcaggacaaaaaagggacgccatccggaaaaatattataaaaatattatttccaccaatctaatgcgattcacggcaagacagacgacaaagaatatgtgcgtgatcgcgatgctgatcttcgtactgctgatctctgctttttggggaatgcagtattatgattctgcattccgaaacggtgaaaatgctccggtcgattattccctgcattatccggcggcagaacagcagattacgaaagaagagatctatgatctggcagacaggcatggggtagaaatcacagattataaggaagcacaggcagcagaacttctgatcatctacgccggcaccgaattaaacgatgacggggaatactatgatgtgaagagggaaaaatatgccacattcctttctgcctctgaattttccagaatcgcgggggaaccggtgtctttgaagccgggagagtataaagccattgtccagcagaactatcaggaagagatatgggcaaagccggaatgcctgctgaaggtggcaagcccggctgccggggaagaaatggagccggtttataaaggaacggtcgcattcgataatctgacacgcgtaagcgatccatttgcatttatcctgtctgatgcggattatgcatcgtataccgctggccttacagaggataacaaagaggatatggttttctttaacgtgaaggatgtgatggatacttatccattcgccaaagaactggaagaagaatatatcgcgcatgccacagatatctcggaccattattttctttatgatgcccgcgaagaagaacttgcaaaaaaagcaggggaaccctacacatattcaggcagggtagggatgacggcggacaatccggaacttcttcaggactggaaatatgcgcctgccttcaaagttcttacaaaaggggaggttatgcagatgattgcggtattcgtgatgcttagcgcctacattgcgataattgccctggcggcaatcggggttatgacttatgtaagaagcgttaccattgctgtcgataacaggcagctgttcgaggatatgaagaagctgggggccagccgggattatgagacgcgggtggtaaaagtacagcttcgcaagatcttcttatatcccggtatcgcaggatgcgggatatccctggtctttacggtcctgatgctcttttttaacaatatgcgcctggaaattgaagaaatcaggctgatcggaatcgagagcattatgattggggcatccgccatcttcctgtacgtactgtaccggatctcttttcggaagatgagaagcatgctggatctatagggaaacaaaatagtgatagtgtttgcaaactttttgtccatggactgcttatattttgcaattaaaaaagaactctacaagttgtaagatgccgtgtgattttccaatgtcgcgtcctgtaaaatgttaaagttgtatcaatcgatacgatactttggcagatatgataagccaaaggaaaagaaaggaaggaaaagttcatgaaacttgtacaggacaaaattacaattatcacaggcggaacccgtggaatcggattcgcagcagcaaaactctttattgagaatggagcaaaagtctccatatttggcgagacccaggaagaggtagacacagcgctggctcagttaaaggaactctatccggaggaagaggtattaggattcgctccagaccttacatcaagagatgctgttatggcagcagttggaacggttgcacagaagtacggaagactggatgtcatgatcaacaacgcaggcattacaatgaattctgtattctccagggtatcagaagaggatttcaaaaatataatggacatcaatgttaacggcgtattcaatggcgcatggtctgcttatcagtgcatgaaagatgcaaagcagggcgttatcatcaatacggcatctgtaaccggaatctatggttccttatcaggaatcggatatcctaccagcaaggcgggcgtaatcggcctgactcatggtcttggaagagagattatccgtaagaacatccgtgtagttggcgttgcacctggcgttgtagatacagatatgacgaaggggcttccaccggagatcctggaggactacttgaagacactgccaatgaagagaatgcttaagccggaagagatcgcgaatgtatatctgttccttgcatccgacctggctagcggcatcacggctacgacgatcagcgtagatggggcttacaggccatagaaaagacatactgctattaattccatagttcatactccaagaacaggcaggcaagaggcatttgcgttttagcgcggatgccccgggcctgcctgatttaattcagctggtatatcatgaaattcagatatgcggcgaacaggcaccatataaggtaggggatctgtagataggcggcaacaggacttatcttgtgaaactgatatatcatcagggctatgaggatgataagcacgagaagccataaaaatgcaaagaggtacatggaaaagccgaaaaagaatatgctccagaggaagttgaagaacagctggataaaatatagtcgaagcgccttattcttttcaggagtttcggattcatagattatataagaagatatccccattaatatatataatatggtccagacgatgggaaataggaaggacggaggactaagaggcggcttattcaatgccaaataggccgccgaattgccgcttaagagagcagacaaggatcctgccgcaagaggaataaggataaaaataatgagagcgcttttgtttttgatgttcatatataccggctccaggcatgactttcaatattatatgaaaaatctccgggaaatatgaacggtatctccggctttacttgccgctctttgacttgcccgccgtctctttgagcagttccaggaattcttccctggcggggttcatgctgttctccatatagattacggaacatccggtgttcaatgtgcgtccggccatgggaacgtagcgaagtccatccatgggcatatccttcatgcaggcggggacaatgccaaagccaatatcagatttggcaagcagagccatgctgtagtaatcgttggcatagattacttcgttgctgcccaggccgagaatattcatgacattccatatctgccattcataggagatgatgtcattctctatcgttcgaagcattggctttcccgtaagactagcgggttccaggctgtcctgctgcgccagttcattgtccgcgctcagaagaaacaggcattcatccttcctcaggggatggactttgagccattggctataattgcggtcgtagtcggatactaccgccaggtccagatatccatcttccagctgctgcaggactttcctctttttctttccatagatgagatctacctggatagatggatggtccttatagaactggcttacgatgggcgtgatggcaaactgttcgtatgcgccgggatacccgatcttaatcagaggcttatcctcttgcgaaacctggcgggcatgggagatggcctggttgtagtctgccataatgtactggcagcgcttatagagatagcccccggctttggtaagcgtcacgccggtattgcttctgtgaaagagctggaagcccagctcgtcttcatatttcttgatctgcaggctcatggcagtctgggatatgaactgttcattggcagcctctgtaaagttcagatatttggcggcggaaagaaaaaatgggagccgtttgatgctcatatgaatacctcctatcgtgggaaggatgccaggcacccttctttttttcattctaccataaattaaacttattgcgggggattaattttaaattatacagcctgaattataagtgttagaatgaacttaataaaaaatgttattaaaataacaaatggtaaaaataaggaggaaatgttatggcacattatgttccaggcgcttatgaaggcatcggccgcggataccgcggcaaacttatcgtgaatgtaaccgttacagaagaaaggattgaaaagattcagatcgtcaagcacaaggaggtgcgaggtcttgcatgggatcttcccacctctccgatcgaggtcatccctccacagattatcgaataccagtcgctgaatattccactggtaaatggtgcggatctgaccagcgcggccatactggacgcggttgcggccgctctgaaagcagcaggggcaacggatgaggacatagaacaactaagacaagcgccggggcctgaggctccagagccaaaggacgaggtgcgcacggttgatgttgccgtattcggcgcaggcgcaggcggactggcggcagcaatcgaagcaaaggaaggcggcgcggacgtcatcctgatcgagaagcagggaattacaggaggctccacggcgcgttccggcggaaaacttctgggcgcaggcaccaaatggcagaaggagcaggggatctatgacacgaaagagatgtgctatgactatctgatggaagtaggaaaccgcaggggagactttatggatgcatccaagaaccgttaccttgtagagcatctgaatgagaccctggattggctgggaacgatgggctaccaggttcaggacgtggaggcgatccatgtatcccttcagccatggagagtacataacagcatgggcggcggcggacagaccaacggccagggcggagagattaccactccccttacccatcattatgtagacaaactgggcggtgagattctatataatacggcgcttaaagaattgcttaccgatgaaaacggtactgtaaacggggcagtgtgcgagaagcttgacggttcaaaacttacggtatacgccaagaaaggcgtgatccttgccaccggaggatattcccgcaataaagagatgtgcgcgcgttacccggtagcccattatttctcaaccactccaaagagcaatgtaggagaggggctgatagcggcagagaagatcggcgcccgcaacttcgtgcatccgggaatccaggtggtttataccagcctgacctgcggcatcggcatcaatgacgagtccgggctgattgtcaatgaacgcggagagcgtgtggtgaatgagtggagctaccagtatcatgtatccgatgcgctggcggcctccggaagcaattgcggatggtacattaccagcggcgacgagccttacagcggcgtacagtatgggttcaagcaggcagtggaaggaaccagcagggataaggcggcggacagcatcgaagaactggcggcaatgataaaatgcgatcctgccgttctgcgcgctacatttgaccggtacagcgagttggttgacaagggcgtggacgaggactttggaaagccatccagattcctgcatcctatcaatgggccgaaatatgcagccctcaggcttcacccttgcgttacggttacctttggaggcctggagacggatgtagccgcacgggtgctggatacagaaggaaggccgatacctggcctgtatgctgctggcgaagttgccgatacgggcatgttcgggacagagtatcctacctgcggcacatccataggcggcgcattgttctacggcagaatcgccggacgggtagcatcgggacagtcaatgctttaaagaacatgaagagatagattgtgtagtatggaaaggagattataggaatgaaaggaacaggccttaacaattttccccagttcggcgtgatggagggagtcaagattctggtgtgcggcggcgcaatcgcgggcccctttggggctacgctgctaggagagattggagcggaagtcgtacattttgaatcgccgaagaacccggacagcgtccgggggcattatggatattcccagaatcaccgcaaccagctgtccatggttgccgatatgaagacgccggagggccttgagatatttaagaaattgatcaagtggacggacatcttcattgagtcatccaaaggaggcacctacgagaaaatgggccttacggatgaggtcctctgggagatcaatccccggctggcaatcgtgcatgtttccggattcggccagaccggcgtgccggagtatatcggccgcgcttcttatgatgcggtggggcaggcattctcaggctatatgagttttaacggcacgcccaaagaggctatgaaggtatctccttatcttagtgattatgtgacggcccttaatacatgctggacagcattggccgcttatgtacatgtgcttcgcacaggcaagggagaatccgtggatgtggcccagtatgagtcgctggcgcggattctggatacgcgtcctatggaatactttaccgatgggaaagaatttccgcgtacaggcaataaggatacccaggctgccctgttcagtttctatacgtgcaaggacggcggcgagatattcatcggaatgaacggctatgggcctgttcgcaggggatatcccctgatcggcctgcccaagccaggggatggagatccggagatcgacgagatcctgtctggctggatggctgacacggatctgggacgaaggctggaggcagccatggagaaattcgtctcagagcatacggtagatgaagtggaaaagatcatgctggagaaccagattccatgccagaaagtctataccctcaaagattgtgcaaaagatccgcactggaaggcaagagatatctttgtcgagtgggatgacccaatgatgggaagggtaaaaggccttggcatcatcaataagtggaagaataatccgggtgagatcaaatggggcgcccctctgtttggagagaataacgaggaggtgctcaaagatctgggctatacagaggaagagattgaagattttgccaaacggggcattacggcatcctttgactttgatcagacgtatgaaatatataagctcgaagaactatttccgcattacagggaaggatttaccgaacgttggaaaaaggaggaagaatagtatgagatttgaaggaaaagcagtcattgtcacgggcgcaagttctggcattgggcgcgcctgcgcaaagatttttgcaatggaaggcgccaaggttgttgctgcggcccgccggctggataggctggaagcactgagggcagaagtagaggcagaaggaggagcaggcagcatcctgcctcttcagacggacgtgcgcgttccaaagcagattgacagaatgttcgatacctgccttgaagaattcgggcatctggatatcctggttaataatgccggagtactggatggacagctgccgatacatgagacctcccaggaaatctatgactacgaatatgagaccaaccagcgcgcggtctacctgggctgccagcgcgcgatcaagatattcctggagcagggaacgcctgccaacatcgtgaatgttgcgtctgcggcgtccatacgcggattgaaaggcggcaccacatatgttatgaccaagcatgccgtgctgggccttactcggaacctctctgtcagcttctatgagaaagggatccgctgcaactgcatcctgccttgcaatatcaagacagagataaaccgcgcggccagagagaagaatatcggcatcctggagtggcagcttcgggcgggcaatgccgcgccgcttcatacgatcactcctccggtggagggagccaagccgattctgggacagccggaggattgcgccagtatcatcacattcctggcagatgataaggcagcccgctatatctccggcgcagaagtaaaggtggatgcgggattcctgaatatgtaacgccttatgtccgctttgccttgtgatttcgctctgtattctgtataatagggaaagaaattgcgaagaggagcaggcgataaagatgaatttgctgacaatggaacatataacgaagtcttatacggaccgggtgcttctggacgatgtaggatttagcatcaatgagaatgaaaagatcggcgtaatcgggattaacgggatgggcaagtccacgctgcttaaggtggcagccgggatcgagccatgcgattcgggaaagatcagcatgggcggccaggtgaagatctgctatctgccccagacccctgtctttcaggaaggaaccacgatactgaaggctgcggtggagggcaatgtggatgaattgaaccgctggaccatagaggcggatgccaaggccatgctgaaccggctgggattcacggattatgaggaacgtatcgggcacatgtcaggcgggcagaagaagcgggtggctctggtcaatgcgcttcttacgcctgcggacatcctggtattggacgagccgaccaaccacctggacaatgcgatgtccgagtggctggaagagtatctgatcagtttccggggagccatcctgatggtgacccatgaccgttatttcctggaccgggtggctaccaggatcgtggaagtggatcagggcaagatatacaattatccgggcaactattctcagttcgtacgcctgaaagaggagcgccagaacatggcgctggcaacagagcgcaagcgaaagagcatcctgaagacggaactggagtggctaagccgtggggcccgggcaagaagcacgaagcagaaggctcacatagaccgcatcaaggccatgcaggagatccgggatatccaggaagaaaagcgggttgccatggattccgtggcatccaggatgggcaataagaccatcgagcttgcgggtatatccaaatcttatgatgacaggaaattgatagaggattacagctatatctttctgaaaaacgaccgcatcggcatcatcgggccaaatgggtgcggaaaatccacgctccttcggattatcaatgggatcgtaaagccggacgcgggcagtttggatataggacagacgatccgcatgggatatttctcccaggagaatgaatacatgaatgattccatgcgggtcattgactatgtcaaagaagtgggagagtatatcacgacttccgacggcaagatcactgcctctcagatgctggaaaacttcctgtttgacggggcgattcagtggtcgaagatcgagaaactctccggcggggaaaagcgcaggctgtatctgctgcggattctgatgggcgcgcccaatgtgctgatcttagatgagccaaccaacgatctggacattcagacgctgaccatactggaggattatctggaccggtttgacggcatcatcatcgtcgtatcccatgaccgctatttcctggaccgtacggtgaaccgtatcttttcttttgaaggggacggcgtgatccgccagttcgaaggcggctactccgattatctgatccgtaaggaattagaagcgcttccagaggaaatggatgcacccggcgcaagaaaggaaagccgggatgacaggacgcctaatgtggaagaaagtccggcagagaattcgaaggacacgtggaagaagcgtgataagaaattaaggttcagttttaaagagcagcgtgaatttgaggctattgacgatgagattgcagccctggaagcgaagatagaggaacttgacagccagatagcggcaaatgcgaccaattcagccaggcttaatgaactgcttaaggataaggaagagatggatcagaaactggaagaaaagatggagagatgggtatatctgaatgacttgaatgaacagatccagaagtcccaatccggcatgtaaaatccattgacggttttttaatcctatgatacgatagatttataaaaaatgaaataactggaaacttatataggttcataatcggttgaacgtttctaccaactaccggaatagttgtctataagtatccgcatgagaagtctgcggatatcttgcggacttcgggaaaggaggatattgccgatgaatgaacctatttttattttacggggggatatctgctacagcaggaatctgacggaactggcagtcatgaagcaaggctatgtgatctgcaaagagggggtatccctgggggtatgccaggaattgcccggagagtatcagaatcttcctatcagggactgtggagaagatctgatcctgccggggctgtgtgatctgcacgtccatgcgccccagtatactttccggggactgggaatggatctggaacttctggactggctgaatgagcatacatttccagaggaaggcaagtaccaggatctggaatatgccagaaaggcatatggagactttgtacataatttgaaggaaagcgcgacgacaagggcctgcatattcggaaccatccatgtgcccgcaacggaacttctaatggatatgctggaggcgtcgggcctgcatactatggtaggaaaagtgaatatggaccgcaattgtccggcttatctgatagaaaagagcgcggatatatccgcggaagataccgtagaatggattaaggactgtaagaagcgctaccagattacccggccgatcctgacgccgcggtttattcccagctgcagcgacgctttgatggagaatctcaagaaggtgcagatgcattttggccttccggtacagtcccatctgtcggagaatcaaagcgaggtggcgtgggtgcaggaactgtgtccccagtcagaattctatggggatgcctatgaccggttcgggctgtttggggcagactgcagcacggtgatggcccactgcgtatactcggacgtgagggagcgtaggcgcatgagggaaaatggcgtctatgtggcccattgcccggagtctaatatgaatctgtcttccggcatcgcgccggtacgggcatttcttaatgagggaattcctgtcgggcttggaagcgatgtggcaggaggaacgagcgaagatatctttgccgccatggcacatgccatccaggcgtcgaagctcaggtggaggctggtggatgatacgttaaagcctctgacggctatagaagcattctatcttggaaccaagggcggcggctccttctttggcaaggtgggaagcctggaagaaggatatgaattcgatgcgcttatcgtcgatgacagcgccatctccagccgggatatggaggtgaaagagcggctggagcgcctgatttatcttagcgggggcgcgaagatcaagggaaaatatgtagcaggaaaagagatattctggaggtgataggatggaggaacgcagagaagttattggcgccagcgtaaagagggtggatgcctttgacaaggttacgggctatgcaaagtatacggatgacctctgcgacaaaggcgcatatatcgcgaagatattgcattctacggtcgcaaacgggagggtgacatcaatagatgcggacgaggccagaaagataccgggcgtgatcaaggtggttacttgctttgacgtgccgaagaattttttccctaccgcaggccacccctggtctacgcaggaaagtcatcaggacgtggcggaccgcctgatgctgacggaccgggtccgtttctacggtgacgatgtggccgcggtcattgcagaagacgaggtggccgccagccaggcccttcgggccattcaggtacagtatgaggagtatcccttcgtgctggatgtacaggaggccatggaagagggcgcgcccagaattcatgaggaatatccggggaatgtactgaagcataccagcatccggaacgggaactacgaggaggcaatcaaggagcctggcctgatcaaagtggagggatggtacgatacgccttccgtgcagcactgccatatcgagaactttatctgctacgcttatcaggccaatcataagatgaatgtggtcagttcgacccagatcccgcatatcgtaaggagggtcgtaggccaggcgctgggagtcccctggggcaaggtaagagtcatcaagccatacatagggggaggattcggcaataagcaggatgtgctctatgaaccgctgtgcgcttatctaagccaggtgacgggaggccatctggtcaagctggatgtaagcagggaagagacctttgcctgcaaccgggtaaggcatgccatccgaagtcatattatatcctatgtcaggtcggacgggacattcgtggccaggaaactggaggcgttctctaatcagggggcctacgcgtcccatggtcacagcgtagtggcaaagggaatgggcgcgttcccgcagttgtatccctgcccgaatgtggaggcagattcctatacggtatttaccaaccgtccggtggcaggtgccatgagaggatatgggattccccaggctatgtttgccgtggaaagccacacggacgacgtggcaaaggcgattggcatgtccccgctggaattcaggagaaagaacctgatgccgaagggattcgtggatggattctctaagaacgagaattatgaggacaccttcagccaatgcatggataaggcgatcgcgcatacggattatgtcaggaaggcagaagcgtatggcaatcagacgggaaatatcaggaagggcattggcattgcggctttctggtacaatacggcggtgtggccgatctctttggagtcctcttcctgccgcatggtactgaaccaggatgggtccatccagattcagcttggagagacggagattggacagggggcggatacggcgtttgcccagatggcagcttcgacgctgggaatcccgctggaagatgtccatgtgatatccaatcaggacacggatcttacgccatttggaacgggggcctacgcttccaggcagacgtatgtgggcggcttttcgatccagcagaccgcgctccttctaaaggagaagatcttaggctatgcccatgagatgacaaggatgcccgctggaattctagatattgtggacgggatgatcgttagaaagtcggatggaagagaactgctgtccatggaagaactggcgctggaagcattctacagcctgagccacagccagcatataacggcggagagcacctatcagatcaaaagcaatgcttattcctttggatgcacggttgcggaagtggaagtagacatcgaggcctgcaaggtcaagctggtggatgcagtcaatgtccatgactgcggcaggctgatcaacccggcgctggccaaggctcaggttcacggcgggatgagcatgggaatcggatatggcctgtcagaatgcctgaagttcgatcccaagaccggaaagacgttgaacggaacgctattggactataagctgtccacaaccatggaccacccggaacttaaggcagactttgtagaaaactatgagcctaccagcgcgtacggaacgaaagcgctgggagagcctccggtctgttccgtggctccagctatccgcaatgcagtattcaacgcgacaggagtcggcgtagacacgctgcctctaagtccccatgtcttattcgaggaatttcggaaaggagggcttctggatgtatgatataaaagcattatatgaggcagataatatatcgcatgcaattcaattactaaaggagcacccggaggctttgatcatcgcaggaggaagcgatgtcctgatccagatccgggaaggcaagagggctggagcagaactggtcagcatctatggattggatgaactgcggggcgtgaagatggaaggagatggaaccatccgcatcggttccctcaccagcttctcccatattacgaaggatgaagtgataaagaagtacatccatgtattgggcgaggctgtcgataaggtgggcggtccgcagatacggaatatcggaaccatcggcggcaatacctgcaatggagtgacctcggcagattcggcctccaccctattcgcctgggatgccattattgaactgacagggccgcagggcgtaagaaaggtgccgatccaggagttctatatcaaggccgggaaggtagatctaagacctgcggagattcagacagccatcctgataccgaaggaatcttacgatggctataagggccactatattaaatatgccatgcgcaatgccatggatatcgcaacgcttggatgttccgtgaatgtaaaattatccgcggacagacagatgattgaagatgccaggatcgcctacggcgtcgccgggcccgtgcctatgcgcgcgccgtcggcagagaaggcggtggcagggtgcaaggtgtcagccgaaagcgtcgagcggttcgcaaaagaagttctaaaagatatccgtccaagggacagctggcgcgccagcaaggcatttcgggagcatatctcctatgtgctggcaaaacgtgcccttacggaagcgattgagaggtcaggaggtgcggtggtatgagtgacaggcagttcaaaagaattcattgtaccattaacgggagagaagtggaaaccatgatagatgtccgcgcttcgctgacagaccttcttcgcaatgatttccggcttaccagcgtaaagaaaggatgcgaagtgggcgaatgcggagcctgcaatgtgatcatagacggcgagtgctttaattcctgcatctatctggctgcgtgggcggacggaaagaatatccgcacgctggaaagcctgatggggccgaatggggaactatctgacatccagcaggcatttatcgatgagacggccgtgcagtgcggcttctgtacgccgggctttatcatgagcgcggtggagatcctggagtcaggaaaggaatattcaagagaagaattaagaaagatgctttccggacatctgtgccggtgcactgggtatgaaaacatcattaacgcagtggagaagaccatgaaaaaaaggctgggcatttaaattgtccgcgtcagcacctgactaagagaggagctggcgcggatattcttattggaattatatattacaagaattcaatgcctgccacagcctgctgccggaaagcggcatattcttcggcaagggcaaggatatcctgccgccggacgcgtgtatcccacagagcggccttgatgtccatgccctttcctttcttgcggctgttccagatgcctacgatctctccgcggtaaatgatggcgcccgggtttgctaccagctgccagattttccggtgcaaagacttgtccggctgcagtatgaggcggtcacgctggtcgagatagggatcgtggccgcccaggaagagaagttccttttggagcggagaaggcgaaaaaaggcgctctctgtcagaggacaggatgaatgccttcttgcccagtacaaggaccggctccatttcttcttctacggctttccacagcctttttccctgggagttggagcatcccagccagcggatgaacatatcgagggtcgcaggcccatagcagtgcaggaacttgcggaccagcctttggggagcatccgccctcacctgcatgggatggcccacccaatttttataggaagtaaaggtgggcgtggttttttggcgttttgcgaatactaccaggccgtgaaaggaacagggacgaagaaggaaagataccaccgcgccgccgaccgtctgcctgtttggatccccatacatggaaggctggttccacaagtcctgtttccgggccggtagaaacggcagcatccagctagccagggtctgatccagggaattcttgctgatgatcaaggcatcatccagccttggcatgactcgcatcaataattccagcagttcgtcaaaatccatctgtagatactcaagggcaagggagatgccgctggtatagatccagggttctttttcgcctccatgatctatagaagctagcgaatagaggaagacatcgctttccgcttccgggaatactaccggtgctccccgatagctccatgcctgcagaagcagcctgtccttattaagcaagtcttccatctgcgacatggtgcagccgggaacccggctgtgaagcgcagtttcccatgcgcctggcggcgtattctgcatgccgcatgctcctgcgagcaaggcaatgtccgacatctggtaatctgcatccagatgatgggaatgaagtcggaaatttcgtatttgttcaatggctggctctttcatgtgcgggatcctttttctcctttttaatcttaactacttgtgcctgagttctatgtctagaatacatcgatttctaatgtctcgcaatatcctctttggaatcctggatgaaactgcctgtttcaggcaaataatagaatgatagaaagatgattgaagacaacaatatattgtggtatgatgttgggtggaatcaataaattgtatgtgaggtagacgtgtatatgagaatcagcaagaggaacggaacaaacgaagcgtattgcccggaaaagatcaagcgggcagtcagcctggcattccaaagtgtaggaaatctgctttctgatgaagaggcagacaggcttcttaagaatgtagagcaaaagattgatgatagagttacagatgagccatccgtatccgtggaagagattcaggattttgtggaacaggcgctgatggaagcaaaccattataaagcattaaaaagttacattttatacagagaggagcgtgctaggaagcgaaagtcaagaaagaagctggctgacaagattccggcctttgaccggctggctttagtactggcggagatccagaaggaatttacgcaggaagagtatgacctggagcatctgtatgccaagttccaggcttttggaaagccggaacttgacgaccaggagaaactttctatgctgatcaaggcggcggtagaactgacgacccaggaagcgccccaatgggagatgatcgcggccaggcttctgatgctggactttgatcaaaaactggataagaatatgagacgctgccatatcgaatgcttctatgacaaactggcatatctgacggaacagggattatacggagactatatcttaaaagcatatgacagggacgagatcgagcgtctggccctttttatcgagccaaagcggaatcacctgtttacttatagcgggcttgaactgctgcttggcagatatgtaatccgcacgggaaagggagtgccgatggaatcgcctcaggaaatgtttctggggatcgccatgcatcttgccatgaaggagaaaaaggacagggaatcgtgggtgaagcgtttctatgatatgctaagtcagctgaaggtgacgatggccacgccaacattgtccaatgcaagaaagccctatcaccagctgtcttcctgctttatagacacggtgccggacagtctggatggaatttacagaagcattgacaattttgccaaggtcagcaaattcggcggcggcatgggcatgtatttcggaaaggtgcgggccagcggcagcgcgatccgcggattcgaaggggcagcagggggcgttatccgctggatcaggctggccaatgataccgcggtcgcggtggatcagctgggcatgcgccagggcgcggttgcggtctatctggacgtatggcaccgggatcttccggaattccttggcctaaggacgaataacggggacgacaggatgaaggctcacgacgtattcccggcagtctgctatccggactacttctggaaggaagcgagggataacatcgaaggagactggtatctgatgtgtcctcatgagatactgacggtgaagggctatgcgctggaagactattttggagaagaatgggaaaaaaggtatcaggactgtgtccgggattcccggatacagaaaagggtcattcccatcaaggatattataaggctgatcatcaaaagcgcggtggagacgggaacgccttttacgttcaaccgggatacggtaaaccgtgccaatcccaacagccacaagggaatcatctactgcagcaacctgtgtacggagatcgcgcagaatatgagcgccatcgagcaggtggagcagaagattgaagagatcgatggggagacggtggtggtgacggttacaaatccgggcgaattcgtggtgtgcaaccttgccagcctctcccttggaagattggatcttgcggatgaggaggagatagcctatataacggagagcgccgtaagagcattggataatgtgatcgacctgaatttcttcccggttccctatgccaggatcaataaccggaaataccggcctatcgggctgggggtcagcggctatcaccacatgctggccaagcatgagattgcctgggagagcgaggagcacctggaatttgccgagaaggtgtttgccgatatccactatgctgccataaaggccagcagcaggattgccagggaaaagggaagttacgaatattttgaaggaagcggatggcagaacggcagctactttgccgaccgggaacttacggatggccggtgggaggaactgcgggcggaagtggcggaatatggccttagaaacggctatcttctggccgtggcgcctaccagcagcaccagcatcattgccggtaccaccgcggggctggatccgatcatgagccgatacttcctggaagagaagaagaatggcctgatgccccgggtagcgccggaattatccatggataacttctggtattataagaatgcccattatattgaccagtcctggtccgtgcgggcatgcggagtcaggcagcggcatattgaccaggcccagagcatgaatctgtatattaccaatgagtataccttccggaaagtgctggatctttatatactggcctgggaagagggcgttaagaccatttattatatccgctccaagagtctggaagtggaagaatgcgaagtatgctcttcataaatattcgaagaagacggaggaaacgatatgtctgaattaatgaaaaagccgctgtttaatccatccggggatacgcaggtgaataagcgcaggatgataggcggcaatacgacgaatctgaatgattttaacaatatgaagtacgactgggtcagcgactggtaccggcaggccatgaataacttctggataccggaagagatcaacatgggcgtggatatcaaggattaccgaaaactgccgcaggcagagcggagagcctatgacaagatcctgtccttcctgatcttcctggacagcatccagacggcgaacctgccaaatatcggggaatacattacggcaaatgaagtgaacctgtgcctgtccatccagaccttccaggaggctgtgcacagccagagctacagctatatgctggataccatctgcgagcctcaggagcggaacgatgtcctgtaccagtggaaggaggaccagcaccttcttaagaggaatgagtttattggcaatctgtacaatgaattccagaagaagaaggatgcaggcgtgctggttaagacgctggtagccaactatattctggaaggaatctatttttacagcggattcatgttcttctataatctgggaaggaataaccggatgcccggctctgtccaggagatccgatatatcaaccgggatgagaatacccatctgtggctgttccgcaatatcctgctggaacttaagaaagaagagccgcaattatttacggaaagccggatagaagaataccgggagatgataaaggaagggtgccagcaggaaatcagctgggggcattacgtgatcggtgacgatatccagggattgaaccgggatatgattacggattatatccagtatcttggaaacctgaggtgtaccaatctgggttttgcgccaatctatgaagggcacgtaaaagagccggacagcatgtcctgggtaagccagttttccaatgccaatatgatcaagacggatttttttgaggcgagaagcacggcttacgcaaaaagcagcgctttggtggatgatttatagaaaggggcctaaaaacagtggaatatcagtggacaaagcaagacggcgcataccaggaatctgacgtgcctgcaagacagaactgccggatcaatattatgacggaagaggaatttcaggaaaagttcccggtattattgtgcagagggttcataggcggcaaggtgagccataaccgattctgcaaggcagaccggctgaataagacggtcgcggggaccttttccattcctttgaaggaatccccgtcaaaggaaaagactacatttggattctgcatgaggaaggaagaactgatatttatcgacgatgccggcaaggtaaggcagatcctggatgagatgcaagggtatccgctgacggacagttcctctccggccttgctgctgtttgactttatggagtatcttctgaaggatgatatgatatttttgcaggagtatgaagaacggctgacaaggctggaagaagagcttctgaatggaaaggcggaaggatttgaccgtaaaatcctgtcttttcgcaaggaattatccgcattaagcgcctattatgaacaactgtcggacatgggagagacgctgcagcagaatgcggcggagcagggagatgaaaaggacagcctgcttttcggcctgtattcagacaaggcagggcgtctgtattctgccgtccagatgctgaaggaatattccatgcagttaagagagatgcaccagacccagatagacgtgcgccagaatgagatcatgaagatgcttacggtggtgaccaccgtattcatgccgcttacgctggtggcgggatggtatgggatgaattttgtcaatatgccggaactggcatccccttatggctatattgttatctgtgccatctgcctgctggtcatcgttgtggagattctgatattcaagatcaaaggatggtttaagtagaatgaatacagaagagccagaggaaggaatcgcggtatggattctcctctggctcttctgctgaagtgcaattatggtaaaatgtgctttttataaatgaaaggtggttccggtggttcccctgacggcctcccgggccttctcaagcagcgtgatcaaggcggttcgcccttccttggaacttgcaaagtctacggctgcctgtactttggggagcatggagcccggcgcgaaatggccttcttccatatactgcctggcttcgtctatagacagatcgccaagccatttctcctctggctttccaaagttgatcgccactttttcaaccgcggtcaggatgatgagataatccgcgtccagttctttggcaagcaggcagctggcgaaatctttatcgatgacggcgcttgcgcctttgaggtgattgccctgacggacgacaggaatgccgcctccgccgcaggcaatgaccagatcgccggattctaccatgttccttatggtgccgatctctatgatttccactggcttgggggaagcaaccacgcggcggtagccgcgaccggaatcctccatcatgatatagtcgtatttctcttccatctcccgggcctgttcggcggatacgaacttgccgattggcttggagggactctggaaggccggatcgttcgcatccacgcgtacctgggtgatcatggtagcaacgggaatgtctgtgatgcctcggttcagcagttcttcgcgtagcgcgttctgcaagtcatagccgatataagcctggctcatggccacacagacggagagaggagtattgggctgctctttatcttcatgtgtcagagcaatcatggcattgttcaccatgccgacctgtggtccgtttccgtgtgcgacgacgacttcgcagccttcctctatgagatccacgattgctttggcggtaatcttaacagctgccatctgttccggcagggtgttcccgagcgcattgccgccaagcgcgattacaattcttttcttttttgccataggttaagcctccgcttcttatttgaatactcttggcttgccgttttcttccagtttttttaggacttgtgctggatcagcgaatttggccaggaagatcatggcagcaatgatataaggcttatagctggcttccttgtataatggggtacggtagcggtcgaatacgcttgcgtccacttcgccggtctcgcagcttacgccagtgatatccgccggcaggcagtgcagatagagcgccttgccgtctttggtggtggacatcagttcttccgtgcatgcccagtccttatgctgggcgttctgtgccagaagttctttctcaagagcatctatgccagcctggtcgccctgcgcatagagttcggttctctgttccattgccgcaaaaggagcccagctctttggatagacgatatcggcatctttgaaggcttctgccatactgttggtcttggtataagagccgccggatttctttgcgttttccgccgccacagcctcgacttccgggaatacttcgtatccttcagggtgcgccagcacgacgtccattccaaatcgtgtcatcagtccgatgacgccctgcggaacagagagcggctttccataggaaggagagtaagcccaggtcatggcaagcttcttgccttttaggttttctacgccgccgaattcgtggatgatatgaagcatatctgccattacctgcgtgggatggtcaatgtcgcactgaaggttgacaagggtaggcttctgctccaggatgccatccttatgaccctgggtaacggaatccaccacttcgtgcatgtaggcgtttcctttgccaatgtacatatcatcccggatgccgatgacatcggccatgaaggagatcatgttggctgtctcgcggaccgtctcgccgtgggcgatctgggacttgccctcgtccagatcctgtaccttaaggcctaagaggttgcaggcagaagcgaaggagaagcgggtgcgggtggagttgtcacggaataaggagatgccaaggccgctttcgaataccttcgtggagatattattctcccgcatgtagcggagcgcgtccgccagcgtaaatacagcttctatctcgtcgtccgtcttctcccaggtgaggaagaagtctccattgtacatttccttaaagttcagtctgtttaatttatcaatataatcctgtaatgttttcataatttatatcctcctgatattgtgatactaagatacaaagggctgcctggggcaagagcctacttgcagtacatggctggcagggccgcatagacggcggcgcaccttaccagatcgtctttccaggtcttttcattgggagcgtgggcctgagcctcggcaccggggccaaatcctatacaggggattccgtttcttcccatgatggatacgccgttggtggagaaggtccatttgtcagtcaggggcctgttgatccgggatggagccgtctcttcatttcccaggcgcttgtcgccgtaaagtcctttataggctgcctccagagccttggtcactttatggtcttctgggatgacccaggtcgggaaatagcattcgatgggatagacgcatccggtgtaggatggacggtcataattgtacatggatacttctacagcgtctccatacttctgtacgcttggcagcccgcggatctcatccaggcagctctcccaagtctcgcctgcggtcatgcggcggtccagagagactgcgcaggagtctgcaacggcgcagcggctgggagaggtgtagaagatctgggaaaccgtgacggtcccttggccgaggaagcgggcctctttccactctggattatatttctcatccagcatctttaccaatcctttgatgctggttttttcatctgcgtcattctcatttaacgcgcggatctcctgcaggatatccgccatcttgtagatcgcattgtctccgcgctccggagcggagccgtggcaggatacgccttttacatccacgcggatctccatgcgtccccgctgcccgcggtagatgccgccgtcggtaggctcagtggatacgacgaattcaggctttacgccgtcctcgttgatgatgtactgccagcagaggccgtcacagtcttcttcctggacggttccggtgactacgacccggtatgtatcatccagaagtcccagatccttcatgatctttgctccatatacggcagatacgatgccgccgcactgatcagaagttccgcgtccgccaatctctgtctcggactcaaagccttcataagggtcgaactcccagttgtcgatgttgccaatgcctaccgtgtcgatgtgggcgtcgtagccgatcagcgtcttgccggttcccatatagcccagaacattgccctgtggatcaatctctaccttgtcaaagtctaatttgcgcatctcctctgcgatccggtcaatgtgggctttctcatcgcagctttctcccggaaatttgacgatatcccttaagaatctggtcatatccgcctcatatttttgcgccgcttcttttatctgattaaaatctaacatcttttttacctcctatatgccttcaaatggttctttatcggttccacataagccttcccagacgatttcccggtaacggtccggatcggtatcgccttctgaggataccagcaggacttcggaactgtcatccagcttcagtgcatcccttaactctctatactcgggcttggtcataagggctgcaaccagtcccatggtgacggagccggattcgccggagaagactctgtcatcgccgcgaagaggcgccccatagatgcgtgtgccgttggcgcttacccagtccgggcaggatacgaacgcgtccgcatgatttctcaggatatcccaggatacggtgttggcttccccgcaggcgaggccggccatgatagtcagcatatccccggtgacatcgattctgcttccgtcgcccttgacggcagagcggtagaggcagtcggcagccatggcttccacgacgaccatgatgggaggattctctttaaagcggttggcaaaatatccgatgaccgcgcctgcaagggatccgacgccagcctggataaagatatgggttggacggcatccatccttggcaagctgctggtcagcctccagggcaagggttccgtagccctgcatgatccaggtaggaatctcttcatagccttcccatgcagtatcctgcaccataatgccatgttccgtattctcggcttccctggcggccatccgcacgcagtcgtcatagttgagatcctcgatggttacggtggcattttcctttgcgatattttcaagacgggtctgggtagagcctttcggcattcttaccacgcatttctggcccagtttgttggcagcccaggcaatgcctcttccgtgattgccgtcggtcgcggtaaagaaggtggcctggccgaattcttctcgcagttctttggaagtaagcacattataaggaacctcgcttacatcctttcccaactgctgcgcgatgtatcttgcgatggcgtaggaaccccccaatactttgaaggcattcaggccaaaacggtaagactcgtctttgacgtacagccgtttcaggcccaagtactccgccagattggaaagcctggtcagcggggtcacgctatactggggaaaactttgatgaaaggcgtgcgccttcgccatctcttcctccgacatattgcgtacttgcaggtcatccgtctttggcatggtattgagtgtccattttaattgattatctgatgctttgctcatgatcgatctcctccaaatcatatatttacttgttgatatctacataactatagagcgtgtacttggagatgccaaagtatttggcaactttatctccagattttgtaataagaaaggcgcctgcatcattcaggaaattgattgccttaatcttatcttccttgctcatcagaggtacaggtactccgaccagcgctacggactgctcgattaattcatccagaagttcgttcacgtcgtgggtgatccgtcttggcgagttggaatcttcgctgccggattcctccggaaccttgcaggcggtgagagagtggatgctcccttccagagccagaaggttggtgatgtcgtaattaatagatagtatatagcgcggttttccgctgtcgtcgttaatatagatggtactggactttaagatgcgtccgctgtccgtcttggtcaggtaggatagtctgtcggcaagcggtccgtcctgatggcggattgcattgagcaccgcgccggacggcccgtcgcctaccttccttcctgtaatatggccattttcaatatggacaatggaactttccgctacattgcgtgccagatcgtggaccacgacttcgcagttatcgccgaactgggctgcaagtcctgtagcaatctgttttaacatgtctaacctggaccctgccatgatcgtacctccttcgtaaggtttttcgtctccctaagttcatcatagcagataattttagaaaatcaatagaaaatctaaaaattttttaggaaacaaaaatatttttgtaaaatccattgcaatttatatataatgatgataatatggtagaaacagaagggttctttgtaaaaagtgtacgaaaaacagcaaaggaacagaagagaaatattaagcagaatgccgggttgcatggtctttcctgcctgatgcggacagagaaatcgacagatatccgaatcccaaatccgcagggaagaaccggcaaatatcagtctttcgtatattggttcggtctccccggtcttggagcctttatacaagagacagaaactacaattttataacgcagactgcgaagatgccggtgggcgccatgggaacggccggtgtccgggcggtctgcagcaaggctctccctggatagtcaagggagataaccgggaggtagaaatggatacacgcgaagtaagtaaagcaggagatgccttatttaagctggacggaaagcctacggcccgtcaggcatttcccctggcactgcagcatgtggtagccatggtcgtaggatgtgtaaccccggcaattataataggaggaatcgcgcaaagaaaaggcgagatcagccaggcggatattacggttctggtgcagtcagcgcttctgatcgcaggcatatcgaccctgatccagctgatttccttcaagtatacgataggctccgggctgccggtcattatcggggtcagttttgcctatcttgcaagcctgcaggggattgcggagcagtttgaccttgcaaccctgtttggagcccagctggctggctccctggctgccatactggtgggaatatttattaagaggctcagattcctgtttccgcctatggtgacaggtacggtggtattcgtgattgggatcacgctgtatcccacagcgatcaattatatggcggggggaagcgggagcaaagattacggcagctggcagaactggacgattgcgcttgtgacgctggcgattgtcacgatcctgaatcatttcggaaaaggcgcggtgaagctatcttccatattacttggaatcctggccggctacggcatggccatgtttcttggaatgattgactttatgccggtacagcaggcagaatggttccatctggcgaagccgtttcattttggaatcagatttgagccttcttctattattacgatggctattctctatatcatcaattccgtacaggccatcggagattttactgccaccacggaaggcggccttggcagggagcctgcgggcagagaactgtcaggaggcatcataggcaatggcttgggaagcatgatcggggcctgcatcggcggccttccgacggcgacattcagccagaatgtaggaattgtggcgacaaccaaggttgtggcaaaaagggtattctatatggcgtcagggattatcctggcagctgggatcataccgaagttcgcatccgtgcttgcgacgattccggcctgcgtgcttggcggggcgacgatcagcgtattctcatccatagccatgacgggaatgaagctgatcgcgaaggaaaagatgggataccgtaattcggcagtggtaggacttggcgttgccttaggcgtgggaatcactctggtgccggagtcattggccatgtttccgggatgggtaaccctgattttcgggaaatcagcggtggtactatccacgatcgtaacggtggtgctaaaccaggtacttccaaaagaacaagaagaagcagcagaataggaggcggacatatgttaataatcggaaatggaaagaccattacaagggacgctaatctcccttttatagaggacggggcagtggctatcgagggaacccggatcaaagaaataggagccaccaaagatatgaaagagaaatataaagaggcagaatacatagatgccagaggcagagtcatcatgccggcgttcatcaatacccatgagcatatctacagcgccatggccagaggattaagtattaagggctatcatccgaaagggttcctggacatcctggatggccagtggtggaccatcgacaggaagcttacgccagaacagattcgatacagcgcggctgacaccatgatctcctgtatccgcaacggcgtgacaacgatcttcgatcatcatgcaagtttcgggcatatcaaagacagcctgtttaccatcgcggaggtggcgaaggaactgggcgtacgctcctgcctgtgttatgaagtatcggaccgggacggcatggagaaggcaaaagaggcggtcatggaaaatgcggcgtttatcaagtatgcgcttcaggatgactcagatatgctggcaggaatgatgggaatgcatgcgcagtttaccatctcggacgcgactatggaactggcagctgccaataagccaaaagagacaggctatcatatccatgtggccgaaggaatcgaagaccttcatgactgcctgaagaagtatggcaagcggatcgtggaccggctgatggattgggatattctgggagagaagacgctgcttggccactgtatctatattaattcccacgagatggatctgatcaaggagacgggcacgatggtggtccataatccagaatccaatatgggcaatgcctgtggctgtcccccgactatggagctggtgcgccgcgggatactgaccggacttggaaccgacgggtatacccacgatatgacggaatcctacaaggtagccaacgtgctgcataagcatcacctgtgcgatcccaatgcggcatggggcgaagtgcccaggatgctttttgagaacaacgccgttattgctggccgctattttaaagcgcctcttggcgtgctgaaagaaggggccgcggcagatgtgatcgtcgtagactataatccgcccacccacctggatgagaacaatatcaatggccatattttatttggaatgaccgggagagatgtggtgaccaccgtcggaaacggcaaggtacttatgaaggaccgggaagtgaaagtgatcgatgtagaagaaaccatggcaagatgcagggaagagtctgcgaaactgtggaagagcatcaatgattaggaggaaaggtatatgagcgatattatgacatgcatgccttttgagcaattgttagattggatcaggacagagcatgatacaaaaggaaccgtatttggagtacgccgaccttatgtggcggcagaaggcagaaacctgtccatcttcggaagaaatctggagacgcccatcggcccggctgccgggccaaacagccagctggcccagaacattgcggcagcctattatgcgggcagccgattctttgaactgaagacggtgcagatcatggacggcgcggaactggcggcatgcgtaaataagccgtgcatcaaagcggatgacgagtgttataactgcgagtggtccaccgaattgtatgtgcctcaggcacaggaagaatatatcaaggcgtggttcctactggcattcatggccagggagtatggccttggcagcatggacggctaccagttcaacatcagcgtaggctatgatctggcaggaatcaagtcgaagaagattgacacctttatcgaaagcatgaaggatgcatctgctaccgagacgttcagggaatgcaggcagtatcttctggaccatgtgtcggagtttcaaaatgtggcgaaggaagatattgaagggatatcagcctgcatctgtaactcagccaccatctccacgctgcatggatgtccgcctcaggaaattgaaagtattgccgactatctgctaaaagaaaagaagatgcatacattcatcaagtgcaatcctacgctgcttggctatgaatttgcccgggaaacgcttaataagatgggatatgactatgtggcgtttgggcgcttccattttgaagatgatcttcaatatgaggatgccatcccaatgcttggaagactgatggaactggcaaagagcctggatctggaattcggggtcaagattacgaataccttcccggtggatgttaaggccggggaactgccaagcgaagagatgtatatgtcaggaaagtctctgtatcccttatccatctcgctggccgcaaaattgtccgaagcatttgaagggcaccttcgcatcgcctattccggaggcgcggacgcgtttaatataggcaagatcgtgggaactggcgtgtggccggtaacggtagccactaccatcttaaagcccggcggataccagaggcttaagcagatggcagagacgctggacgatatgggggttttgccttttaaaggaatcgatgtagaagcactgaagcgggtagcggaagatgccattacagacaggcatcatgtaaagccggcaaaactgccggtatccaggaagtcgaaggaaaaggttccgcttcttgactgctacacggcaccttgcgaggatgcctgtcccatccaccaggaagtcagcacctatatgcagctggcaggggaagagaagtataaggaggcactgcaggttatcctgaaccggaatgcgctgccatttattacgggaaccatctgcgcccacggctgccagagccattgcacacgcaacttctatgagtcgccggtgcagatccgcgataccaagctggagtgcgcaaaagccgcatatgagtctgttctttcctctctgaaaaaggaggattgctgccataagaaggtggccatcgttggaggaggtccatccggcatggcggcagccttctatcttgcaaggatgggggctgacgtcgccatctatgaaaagaggcagaaactgggcggaatcgtgagcgcggtgattccggactttcggattgatgacagcgtgattgaaaaggatgctgctctgcttgagaaactgggggttaaggttttctatggcagggaagtgacttccgtcaaggaacttcaggaagaatatgatgcggttattcttgccgtaggcgcgtataagcggggacagctcaagctggatggcaaggaagtaagaaatgcgctggagtttctggaagaattcaatcgggcgaagggaactgtcaatcttggcaaacatgtggtggtgatcggaggcggcaatacagccatggatacggccagggcagccaagcggtgcgcgggcgtagagcacgtctacctggcataccggcgcacgaagcgttatatgccggcagacgagcatgaacttctgctggcgattgaggacggggtggagtttaaagaactgctggctccggaccggatggaagaaggccgcctgatctgcaaggtgacgaggcttggcgagccagatggctccggacgcgccagtgtcatcgtaacggatcagacagaggaaattcctgcggatacggtgatcgcggcagtcggtgaacaggttcctaccgacttctatgaagccaacggcatccatgtggacggcaagggccgcgccctggtaagcgattctctggagacaaatcggaaaggcgtttatgtgatcggagatggattattcggaccatccttggtggtaaagggcatggccaatgcaataaaggcagcggaatctattctgggcatggaaatatccggcagtatggcgagggcagccagggaagaagagatctacgcaaagaagggaattctcgcggaaccgggacagaaggaggcggacagatgcctaagctgctctaccgtatgcgaaaactgcgtggatgtctgtccaaaccgggcaaatatatccattcacgtgccgggtatggacaaaaggcaggtcatccatgtagactatatgtgtaatgagtgtggtaactgcaagagtttctgtccatatgaaagcgcgccttatctggataagtttaccctgttcgccagcgaggaagatatggcagacagcaggaatgagggatttacagtgctggatagggaaaaggcctcctgcaaggtgcggtatctgggcgaagagttcgcatgggaaaagggaaaagatgcgaagcttccgctgggtcttatgagactgatagagaccgtgtgcagagactatacatatttactctataaataataactaagatttgtatagaaagaaggcagatgctatgaaacgattattccgcggcggcaccgtggtaagcggtgacggacttaagaaaatggatgtcctggtgaagggtgagaagattcttgccatgggcgaggatctggaatttaaagacgcagagatagtagacgtgacggggaaactactgtttcctgggttcattgacccgcatacccacatggatctggaggtgtcgggtaccgtgactgctgacgggtttgatacaggaaccaaggcagaaatcgcaggaggcaccacctgcatcatcgactttgccactcagaataagggggaaagcctttcctttgcccttcagcactggcatgaaaaggcggatggcaaggccagctgtgattatgcgttccatctcgctctgtcggactggagggaagagatctgcgaggaactggaagcggtggcagcaggcggaatacattcgttcaaactatatatgacatacgatgccatgatggtagatgataaaagcatgtatgaggttcttctaaggcttaaggaactgggcgggatcgcaggcgtgcactgcgagaaccatggcatcatcggggcaaggcttgatgagacgctaaggaacaaaggttccaggaaaaatgtggcggattatccggataccaggccggccctggctgaggccgaggcaatcggccgtctgcttaagatagccagatgcgtggatactccggtcatcatcgtgcatctaagttccaaggaaggatacgaagagatccgaagagcaagggatgcagggcagacggtgtatgtggagacctgtccgcagtaccttctgctggatagaagcagatatgagctggaaggacaggaagccagaaaatatatgatcgcgcctcctttaaggaatcaggaagaccagggagtactgtggaatgccctgaaggagggaacgatacagacgattggaacagaccactgcagttttaccgcccagcagaaggagatgggggcagaagacttctccaaaacgccatgcggcatgccaggcgcacaagagcgtccggcgctcatctatcatttcggcgtgaatgaaggaaggattactttggagcagatgtgcagctatctggcggagaatccggcgaaactgtaccacctttatccaaggaaaggggcaatcctgccgggaagcgacgcggatatcgtggtgtgggatcctgagactgcgtggacccttgccgccgaaaaccagcagtcggcatccgggttctgcccgatggaaggaacgcaggtcaaaggaagggcagagcaggtctatctgcgaggaaccctggtggcggaaaatggcgaggtgaaagaggcatatcaaggaacgtatgtaaaggcagaagcatgaggatagaaagttatatagaggatggctggaaaaagcaaggcagcctgtatgaagcactaggattgaataacagagagcccgggattctctcggtcgtgggagcaggaggaaagacgacggtaattgccaggcttatgaaagagcatgaaaagagaggcattcccgtcgtggtatccaccactacccacatccagcagatccaagcatcttatttcctggataagccgtccgtgcaacgcatgagacagattctgaaggatacgggaaaggtctggatgggggatccctgcgggaatgggaagatccaagcatttccggaacaggaacagaagaaactgcttgacgaggcaattgcgatgggagcctgcgtgctaattgaggcagatggcgcgaaagggcgtccctgcaaggcgccggcggactacgagccggtacttcatcccgattcggtcctggtgctgtcggtctatgggctgcaggcaatcggcgcagccatcgaagattcctgcctgagagttgataaggtggaggaaatattgggaaagagtggtcaggacatcctgaccactcatgatatagcgatattagccgcaagccgaaaaggcggaagaaaaggcgttgcctcttctatggattatcaggtgattctgaatcaggcagacgatgaaagattaaaagaggcagcggctggaatcggagaggaacttttccagcaaggcattcgaagggtacacaggacgacggggctgtcagaagagaccggacagctacggggatcggggcagacaagaataggcgggcaggaggagacagaagaatgaagatcttgataaaaggcgcgggggatctggccacaggaattgcggcgaggctgcatgcgtgcggttataagatagtgatgacagagatcgcggttcctcttactgtgcgaagatctgttgcattttccagagcggtctatgaaggggaagcccaggtggaggatgtgcgcgcggtactggtgcgggatcttaaaggagccgaaaaggtgctggaagaaggccggattgcggtgatcgtggatgagaccgcaagcatacgggaagcatatcagccggaagtcgtgatcgacgcggtgatggcaaagcgtaatatagggacctgcatcacggatgcgcctttggtcatcggaattggcccgggcttcaccgcaggagaggactgccactttgtcattgagacgaagcgggggcacgatcttggacgggtgatcgcgaatgggtgtgctatccctgatacgggcgtgccaggagagatcggaggatatgcgtccgaacggctgatacgcgcccgggcggacggaatcatggagccttgcgccacgatcggcgatgtggtggaaaaaggacagaaggtggcagagacaggcagcgccgcagtatatgccgagatgacgggaattgtccggggaatgctgcagccgggcgtgcgtgtgaccaagggattaaaaatcggcgatattgacgcgcgccagtgccgggagtattgcgagagcatatcggataaggcgagaagcatcggcggaggcgtgctggaggcagtgacaaggtatgagcggcagaaatatgaatggggcagcaggtatgccatcatccttctggctgccggaagcagtgtcaggtatggcgccaacaagctgcttgaggagacgaaaggcatgcccatgtaccagcatatgctaaaggccttaagcgcgtttccggccctttataggattgtggtgagccgctatcctgagattcttgaggatgccgaaaggctgggcatgcaggcggttgtaaatcagcagcccgcgcttggcatttcccattccctgattctgggccttcgggaggccatggcagaaaatccggatctgaaaggcgtcctgttcgccgtgtgcgaccagccggaacttaaggccgataccatcagccgcctgctgcgaaaggcgcaggagaatcccgggaagatcgtatgcgcgggaaggaacggacggccagggaatccagtagtctgggatcagagatactttaaggaattgcttggccttgccggagataccggaggacgccaggtaatgaaaaattatcccggggacatcctggtattggagacggcggaggaagaactgcgggatatagacaggaaagaagatatgaccgagtagggaggggttctatgtatcggttacatataaatggacaaatctatgagacagagacggataagaagcttatccggtacttaagggatgaccttcgcctgacatcggtaaaggacggatgcagcgaaggcgcatgcggcacatgcacggtgattgtggacgggaaggctacaagggcatgtattccgatggtgtcaaagatggaaggaaagaagattcttacggtggaaggattaagccagcgggaaaaggacgtatatggctatgcttttgccaaggcaggggctgtacagtgcgggttctgcatcccgggaatggtcatgtgcgccaaggctctgctggatgtaaacccggctcctgacaggctggaagtcatagcggcaatccgtaataatgtctgtcggtgcactggctataagaagatcattgaggcgattcttttaagcgcccggatcttaagagaaggtctgccggtggaggaagagcagggaaaggttcctgtgggaatggccatgcagaggatcgacgcgcgagaaaaggtgctggggacgggggaatacccggacgacgtctatctggatggcatgatctatgcaagcgcggtcagatccaagtatcccagggcccgggtgctggcgatccatacaaagaaggcccggggactgcaaggggtcgtaggcgtatttaccgccaacgacattcccggcgatatcaaggtgggccatctgaagcaggattgggatgccctgatcccggtaggaggaatgactcattatctgggagatgccatctgccttgtggcagcggaaagcatggaagtgctggaagaggcgaagagcctggtggaagtggactatgaagtgcaggaaggggtattcgacccattcgaggcccttaaagaaggcgctccaaaggttcatgaaagcggcaatatattggcccatgaacatctgataaggggagacgcaggccaggcaatcgccagggcaaagtataaggtgaccaatcattatgagaccccctggacagaacacgccttcctggagccggagacagcggtggcaatgccttttgacgacggggtattcatctactctacagaccagggaacctatgacacgcagcatgagtgctccttgatgctgggccttcccagggaaaagattattgtggaaaataaactggtgggaggcggattcggcggcaaggaagacgtgaccgtgcagcaccatgcggcgctggtcgcttatctgaccaagcggatcgtgaaggtgaaattgaccaggaaagagagcatcctgattcatccaaagcgccatccgatgtggattgacgtgactacggcctgtgacgaagagggatacctggtagggatgaaagcaaaagtagtgtcagataccggcgcttacgcatcccttggcgggccggtgctccagcgggcctgtacccatgcggccggaccatataacttccagaacatagacatcgacggtacggcagtctataccaataaccctccggcaggggcgtttcgtggattcggcgtgacccagacctgctttgcgtcggagatgaatctgaaccagctggcggaaatggtggggatctcgccatgggagattcgctaccgcaacgcgatccgtccgggacaggtactgccaaatggccagattgcggatgcttctacagcggtggcagagacgctggaagcggtaaaagacatctatgacagcgagccttatgccggaatcgcctgtgcaatgaagaatgcgggcgtgggcgtaggactgccggactggggacgctgccgcctgctggtcaaggaagggaaggtccagattcataccggcgcttcctgcatcgggcagggactaggcagcgtgctggtgcaggtgctatcggaaaccacaggccttacgcttgacgagatcgaatactgcaggccgaatacttccatggctccggattccggcaccacatccggctccaggcagacgctggtaaccggagaggcagccaggcgggcggccttgaaactgtgcgaggacttaaaagagcatagcctggatgggctggaaggaaaggaatattatggagagtatctggcaaagacggataagatgggggcggacgtgcaaaaccccgtatcccatgtggcctacggatacgccacccagctgtgcgcgctgaatgaggacggaaccgtgaagagaatggcggcggcccatgcccttggaaaggcggtcaatccgctgagcgtggaaggccagattgaaggcggcgtagtcatgggcatgggattcgccctgacggagaggttccctctggaagaggggatgccgaaggccaaattcggaaccctggggctgttcaaagcagacaaggttcccaaattacagtctattattgtggagaagccgggcatcgaggaggcatacggggcaatcggaatcggagagatcacttctattccgacggcgcctgccatagccggggcatattacagatggaacggcaagttccagacgcagctgcctctggagggaacgccctataagaaataatacataaagtaactttaggtctggaggtcctttgaatgaaatgtggaataacggatattgccaggatactgggaattacgaccagcgcgatccggtattttgaaaaagagcatctgatcaacgtgggaaaagagaagaacgggcaccgctattataatgaagaggatgtattccggcttctttcctacacaaaataccggtccatggagattccgatgaaacagatcgtaacgcagttcagcggcgaagaaaataactggaagaagatctgcgaaagggagatagaggcaaggaacgcggctcttgaaaaagcgcgtcattatcaggaactggccgctaatataaaggagcatatcaaaagcatccaattgattgagagactgaacggaagatatgagtttgacaagtccccggggatcatctttgcacaggatgacatcggcggctggcttccaaaagaacgtgacaggcaggacatggtaaagcagtgggtaaagaatatgccggaagtctgccttgccgtgcgcagaagttcggatgagagcagtggctttggctatatcatcgacgctgacagccccttgaaggaacaactcccgatggggcttaaagttctgaggcttaacgcggcttcctgcctccacacgattgtaaaggcagagggtgattttgcattccatccccagaagtgcttcctcagcgcatatgagtatgctaagggcagaaactttcaggtctgcggccagccgtgggggaagatccttcttgtcgaagtggagagaggccagcatctgcatacctatgtggaactgtggatgccgatttgttaaataattcccaattaaggcttgcaagtaaaggaactttatatgataggatgaacttaaagaaagatggatccaatcttttgcaactattgaatatgaatgcaaaggggtaaagaattatgatgaaagagaatcataagatattgttcgaacctatcaagatcggcaagcttgaattaaagaaccgatatgtcatggctccaatggggcccggcggactctgcgatgagcagggctgctataatgaaaaaggcgtggagtactatgtaaggcgtgcccagggcggtaccgggctgattatgacgggcgttacttatgtggagaatgagatcgagaaatgcgtgatgccttctatgccttgtcctaccgtcaatccattaaactttatcaagacggcaaagccaatgacagaaagagtccatgcctatggggcaaaaatattttcccagctttccggaggcttcgggagagtcagcatcccaagcatcgtagggaaggtggcggtagggccatcccctattccgcaccggtttctggatgatgtcatctgccgggaacttacggtagaagagatacatacttatatcagaaagtttgccgaggcagcggcagtctgcaaaaaggcgggattcgacggcgttgagatccatgcggttcatgaaggatatctgctggaccagtttgcaatctcattctacaatcagaggacggatgaatatggcggctctctggcaaacagactccggtttgcgacggagatcgtgcaggcgatcaagcaggaatgcggccaggattatccggtttccctcagatatagtctcaagagtttcgtaaaagactggagagagggcgcgcttccaggcgaagagttccaggaaaagggacgggacatcgaagaaggaaaagaggctgcaagacttcttgtagaagcaggctacgatgcgttgaacgcggatgtaggcacctatgattcctggtactggaaccatccgccgatgtatcatgagaaaggaatgtatcttccttacaatgaaattctcaagacggtggttgacgttccggtcattacggcaggacgtatggaaaatccggatctggccagcgaagctataaggaagggccagacggatatgatcgctcttgggaggccgctccttgcagacccggatattccgaacaagatcatgcgtggagaatttgaagaggtacgtccctgcctttcctgccaggaaggatgtatgggaaggctggcggcctacgctcagatttcctgcgctgtcaatcctgcgtgtggccgggaggcggagtatggcctgacaccggctatggcatccaaggagatattgatcgtgggaggcggagttgcaggaatggaagcagccagagtcagcgcgatgaggggtcataaggtgaccttatgcgagaaggcctcatctctgggaggcaatttgatcccaggcggagcgcccggattcaaagaagacgaccatgccttgatccgctggtatgatctccagttaaagaaactcggagtcgatgtacagcttaataagacgattaccatagaagaattaaaagcgtccaaggcggacgagatcattctggctacgggctctaacccgaagatgctgaagattcagggagcagagatgcttgctgccgaggatgtcctcacagagaaggcggatgcgggaaaatctacgattattatcggcggaggactggttggatgcgagactgccctgtggctgaaaaaggacaggaacgtagatgtcaccatcgtggaacttatgcaggatatcttaagcgtgggcgggcctttatgctcggcgaataaggatatgcttcaagacctgctgaaattccataagatcgatattcttaccggcagctgcgtgacggaaaagacggcagaaggctaccgggtaaagactccggacggagagaagacgatctctgccgacacggtaatctgcgcggtaggctatgcgcctgaacgaggaatttatgaagaaatcaaggcatccatgccatacgtgcatctgctcggggatgcggaacaggtgagcaacatcatgtacgcaatatggaatgcgtatgaattggccagaaatatatagatggatcaagacagcgttatccggaccgatccggcaatccttttaaggaactgccggatcggtccttttttgatatgttctggcaatgtatgctgacttagagtataataggagtaacatttagggagggcatgagattatgtggactagagaacaattgaagaggaatggaaagtttgcttttcagagaaattactggccttgcgtaggcgtaacttttattatgatggtggtgtcagccgtttttagcgtaggcagttcctgggggaaccggagatattcgatatctgccaccaattattataacagcggccatcatctttacagtcacagctataccagatattttcccagggtcggggtggcaatgggcatcgtcatattgctggtggctctgcttgtcgcgctgcttcggatatttatagggaatcttctggaagtcggcggcaagcgtttctttatattgaataagaatggaaccccggatgtggccaccatttttgacggattcaagtccggacattacgggaatatcgtgctgacaatatttctgagggacctgtttatatccctttggactctgcttttagtaataccgggaattgtcaagatttatgagtatcttatggtgccttatatcctggcggagaatccggcaatggatagaaaatcggcttttgcgatcagcaagcggatgatggatggggaaaaactgaaggcatttgaacttacgctttcttttctgggctggtacttcctgtccctgatcacctgcgggatagtggggattttctttgtgaatccatatgcggaggcaacaatggcggaactgtatgcctataataaggcaaaggcattccaggaaggatatatcaggtagcatcaacgcgcgtgcttagaatagtcaaggaggggcagttatggaactggaaagataccgcctgtgcgcagaggcggcaaagaagaatgcgaaggcagaacttgtgcttaagaatgcaaatgtggttaatgtatttaccggagaagtcatcaaaggggatgtggctatagcagagggcatcgtcgtgggcgtaggccaatttgaaggaattgaagaaagagatatggagggaaaatacctctgtccgggattcatcgacagccatctccatctggagtctacgctggtgacgccttctgaactgattggccaggcggtgcagtgcggcaccacgacctatattgtggatccccatgaatctgccaatgtatcaggggcggcgggaattgactatatactggaacagaccgagaatgtggaggcgaatgtgtatgtgatgatgccttcctgcgtgccgtctacggaatttgatgataatggatgtgaatttacggccgataagatgaagccttatctggatcatccccggatactcggcctgggggaagtgatggactatgtatccgtggtaagcggggatgccaggatgcacgagaaactggaactatttcaggggaggacattggatggccatgcgccagggcttggcgacgaggatatggcagcgtatgcaatggctggaatcgctacggatcatgaatgcacggactttgattatgcgctgaaagaacgccgcttaggcatgcagatcttaatccgggaaggcagtgccgccaggaatctggaggcaatcgtgaagggaatcgtagagcatggaatcagtacggaaggcttctgcttctgtacggacgacaagcatatagaagagattcaaaaagatgggcatattaattataacgttaagaaggccgtggaattaggcatccctgccgtacaggcaatccagatggccacggttaatgcggcaaaatgctatgggcttcggcatatcggggcgattgcgccgggataccaggccgacatcgtggtgctggatgatctatgcagcatgaatgtcagcgaagtgttctttaaagggaagaaagcaggcgggaatgaactggataagagaagagaatgcccgagtggactgaagcacacgatacatctggagaacttctcaaaagaatgcctgaagcttccgctgcaagggaagcgtgcgcatgtcatccagatggaggaaggacagatcaccacgaaggaccttgtatgccaggttccgggagagaaggagttcgaggcagaccaagaattcaataagattgccgtgatcgagcggcataaaggaaccggcagaaccggagtcggcatcctgtccgggttcgggcttcgcggcggcgccatcgcttccagcgtgtcccatgattcccacaatatcatcgtcgtaggagataatgatgcggatatggaactggcggtcaacgagctggtacgcacccagggcggctataccatcgtcgagaatggagcggtgtctatgacgctggcgcttccgatcatggggcttatgagcgacgcaggatatgaaaatgtcaatgccacgcttaagaagatgctggcaaaagcgcatcagatgggcgttccgaaggggatggagccattcataaccctgtctttcatggctcttccggtgataccacaactgcggatcacgcccaggggactatttagcgtctccgagttttgcctgcttgatacaattagaaatggagaagacaatggcaattaacagatcaatgagaatggtactaaaagcactgtcgtttgacggaatagaggtagaggcttcccggcatctcgcgaatcttaaggcgatcgatcctatgaagatattctaccgtaccatggattataagatatataatgatgactatgagattccggtaaggatctacctgccaagggaaaaggagacggaaggcctgccggtcatgctgttctttcatggcggtggctgggtcactgaaagcatcgataattacgagcgcatctgtgccagaatggcggaggccacgaatcatatcgtggtatccgtgggctaccggctggccccggaatataagttcccgattggcttaaatgactgctatgcggtggccaaggccgtgtatacgaatcgcttcattctggaggcggatccggataggattacgctgatcggagacagcgcgggaggaaatcttgcggcagcattgtcgctgatggcaagagataagggagaattcctgccaaagcggcagatcctgatctatccggctacgtactgcgactatggggagaatacgccttttcgctccgtgcgggagaatgggagcgattatcttctgacagccggaaagatgcaggattatatcaatctgtatgcttcctgcgaggaggataagaaaaataaatatttcgcgcctctaagggagcgggatttttcgaatcagccaaagacattgatccttacagcagaatatgaccccctcagagatgagggagaagcgtacggcaagcggcttgccaatgccggtaacgaagtggagatccaccggatcaaggacgcgctccacgggtattttgctcttggaatcaagtattaccatgtccaggaaagttttgagattatcaatcagtttttaagggaggactagccagtgtttcagcaaaaaagggcatattggaggaatctggataatgcagcgaagttattttccgccacaagcagtccgaaagatacccgggtattccggttctactgcatattgaaagaagagatcgatccagaacttttgcaggaggcattaaaccggacggtcaaacgatatccggtattcctgtctgtcatgcgaaaggggctgttctggcattacctggaaaagagcgagttaagaccggttgttagagaagagtacaaggagccctgcagctgcctgtatgtaagagacaagaaggcgcttctgtttgaagtgacctattatcacaaccggatcaattttgaagtgttccacgccttgacggacggaaccggggctacccagtttttgcgggaactggtgaagaattacctgcatctcgcacaccaggaggatggccttgcagatgtgatactgacggatgaaaaggttacgatacgcgatcaggaagacgacagtttcagcaaatattacaatccggatatgaaaaggagcaaaaagaaaaagccgcatgcctatcagataaaaaagatgcgcaaagaatatgacgagttacgcgtaatcgaaggcacggcatcggtaaaagatgtgcttgcggtatcccgggaaaagggcgtgtctatgacggtgctgcttacggcagtctatctgtgcgcgatccatgaggagatgtccaggcttcaggaaaagcggccggtaatattgatggtgccggtgaatctgaggaaggtatttccatcggattccatgctgaactttttcggatatattgagccattccacaaatttggagaaggccgtgacgaattttcgcagatattggaagaagtaaaagaatattttgatgaaaatctaaaaaaggaacagattgcccgtggaatgaatgaattaatcgccttcgagaagaataggattctaagatgggcgcctctggaacttaagaatccctgcataaaagtaggagcaaagatggcagaaaaggaagtgacggcaatcttttccaatatgagcgcggtcaggatgccaaaggaatatacgccgtatatcgagcgcttcggcgtctatacaagcacgccgaaggttgaactgtgcgtctgctcatttcaggatgtgctttcctttggcttcacatcccggtatgacagttccaatatccagcgtaatttttaccgtatcttggaggaattgggaattcccagcaagattgaaaagccggatttcccggaagaggtaaagccgaattatgaaggaatgaagttctttaaggtgttctcattctgctgcatcgcggcagtcgtcatagggatcatgggaaatgccatatttacgcctgaaaggtactgggcagcatttgtcgcggcgggggcgcttagcatgtggtttgccctggccgtgggatatctgaagcggcataacctgcttaagaacgccatgtggcagctgcttgtggtgacgattgggtgtatcctatgggacttgtgcaccggatggcatggatggtcggtgaattatgtgttgccgggcgtatgcataatcatccagatctccatgatgatcatatcaaagattcaatcccattcgccgcgggagtatatgatctattatgtcatggcagcgggatacgggattctacttccgttcatactattattgacaaaggtcatcacgtttactgccccggcggtggtgtgcgtgggattcagcttcttattcctgcttgcgcttatcctgtttaagggacgggagttcaaggaagagatgcataagaagctgcatgtataaaaatggcatgtataaaaaagcatgtaaaaaggagcatgattctatgggaaaacgagtattcctgattgtactggacagcgttggagtaggcgaagcgccggatgcgggcaagtttgacgatgtcggatgcgatacatttggcacctgtgtccgaagcggcaagctgaaggtgccgaacctggaagccttaggcatctataatatccaggggacatctttttacaatccggggaaagaggtggccggatgttatggccgtatgcaggagaagtcggcaggaaaggatacgacggtagggcactgggagatcgcgggcgtcgtgtcagaaaaagcaatgcctacctatccccatggatttccggaggaaattattgaggaatttgaaatgagcaccggaagaggaacgctgtgtaatcttccatactccgggacagatgtaatacgggattatggaagggagcatgtccgtaccggaaaactgatcgtctatacttcagcggatagcgtattccaggttgcggcccatgaagatgtgatccctctggaagaattatatgaggactgccggaaggcaagagccatactgaaaggcgagcacggcgtaggacgcgtgatcgcaaggccctttgttggagaatatccggattatgcaaggacggtgaaccgccatgatttttccctggaaccgccaggacagacgattctggatgcgcttagggaggcaggatatgcggtcatcggcgtaggtaagatctatgatatctttgcaggaaaagggataaccgagacctatcccaatgaagggaatacccggaatatggaacgaaccctggaattgacagacagagatttcgaagggctgtgcttcgtgaatctggtcgactttgacatgatgtacgggcacaggaatgatatcgacgggtatgtagcagcgctcaatgaagtggatatccagattgggcggctgatggagaagatggggcctgaggatctgctgatgattacggctgaccatgggtgcgacccaggctttaaaggcacggatcacagcagggaatatacgccctgcctgtgttacggcaggaatctaaagaaaggaatcgaccttggcaccagaagcagttttgctgatatcgcgcagacgatcgcagacatattcggggtggcatacggaggtgacggagaaagtttttacaaaaatattcttacatcaaaaaaatttgcatgatataatatagcgtatagaggaattatgtcggtataaaaagaacttcatagatgtaggtccgaacaggagggaattatgtgtttaagattggtgattatgtaactcattataaagaaggggtctgtgaagtaattgatatcggaaaactggacatgagatgttcagacaggaagaaggaatattatacgctgaagccattatatgatgccggtggaacattgtatatgccagttgccaacgaaagaaaccagatacggggagtcatcactcacgacgaagcccaggctttgatagaggatatcccgaatattgaagcgctgtgggtgacggacgagaagaagcgggaatccttatataaggaagcggtgtttaagaatcaatgcaaggagtggatcgcgattatcaagacatcctatctgcgcaagatggatcgtttgtcttccgggaaaaaatcaataaatgtagacgataaatacctgagcattgcagagcagttcctgtatggggaactggctgtggctcttgcaatgcctaaggaaaagattcgcgagtatattacagagcgaatgggaaaactggaggcataggagaagaaggcttcctgcagcttgctgcgggggccttttttatagtattcgggagccgaggagactgaatatagaaagtgaaatgatagagtaacagaaaatataaaaataattgaaaaacatattgacaaatcggtggaaatatactaatattataaacaaataatagacgaggcaaaaaaacaaatagttctatagtatattcgtttggagtcagtttattatttcaaagatttgaagagcattgtatcatttataaaggattttggaaagatattttatcagaggataaatcatagtttcaaaataaaataattataaatgtgaagatgcagattcaaattatagtttatgaaagggaggtacagaccgccaaagaattaaactatgaatgctgattcaggttaatggacttgaggaaggcacagatcggaaagcagagtaccgtgagatggagatcaaaagattgaaacagtaacgggaaagttatatgccggaagatggaatgccagaagaggaggttaagaggaatcagtaaaaaattaccagaccctgtatacaggagaaagaggtaagaatgattgaagaatcaaagtaaagatgggtatcaatgtaagattagttgatacccatctttactgttgtattttagaagatgatccgaataatagagaaaggaaatgtatgagtattcaaaggtaatatcatataaacactactatgcagattgatatacaggcagtcatgaaactccctgctcttgcggaaagcaatttcgcggcagggaaagaaggaaggcatacgaaggtaaaaggagtcaccgtgctcgaaattacggatctggatgaccagggcagcgatctgctgagcattcacgagggagatctggtactgagcgcttgcaatgatatcagggatgatctagagaagcagctgcttctggttcaagtgcttaagaagtgcaaggcctcggggctcgtattgttctacgtgggcgaggtaatccgcaatcttgatgcagaagtgcttagactctgcgaccagcttagttttcccttgatctgtccgaagggaaagaggggaaagcggctggaatactcttctgtgatatcagaggtaacagctttgctgctgcagaaaggcaagcagcaggagaagcgggagagggagaatataaacgaactgcttaaaatggtacaggatggaaaatcgctgcaagaagggctggcttacatcagcggccagtacggaatatccgttgtaattctgaatgagagaaggtcggcggcgtttgctgccggggaacgccaggaatacttaagaacggcagtcttagaagaactcaaggattttgaatgtaagagggtgcggtttatcaaagagcagttctggctctgcttctgcgagaacgagggtgtagagattgagaaaagcgtgaagtattctgtattttctattctggaattttctctggaactttggcagaacgagctggtatcccagagcaagaaggaactgatccgggcaattgtccgggggagagaggaatatgctcagactctcgcaaaagagcagggaatcgaccttgggaaaatcagaggattctttctgctgtcggaggacatgccagaagaggccttcgagaaatttcaggaatttgcagaggaaacagccaagtggcacggagtccgactggtgaaaagcggataccagaaagttaaggtatttctgatgtttacggcgtatgcgtttcccattctggaattctttcatacgctggaggcggaacttcctggagaggctatattgctggcttgccatacgaatatggaaaaagaactgttccttctgctgcccagggcagtagaattctacgcatttctgggaaggatatatggaaagaggaaggcattgggcagatacgaattgcagatgtgcatgcaatacagactgcttgtggaaggcaaggagaagcaagtgctttgcctctatgattccatgctgtccgtcttaaaggattatgatgagaaaaataacagcagtattgtggatacgctgctggaagtgatgctgaaccatgcgatgaaccttaagaaagcagcggaaaatatgtttgtccactataatacggtccaataccgcattaagaaaatagaagatctgctccagatgaatattaagtcgccggaagacttgagcgcgctgtatatgacagcgctgcgggaagcctgcctgcgtattggtgaaaactgacaaaaaaagcagcccctttttggtagaaggggttgttttttttataacagcaggctgtgctgtttagttttattacaattgtaaatcgaccgcttctgacatagaatcagcatatcctaacacaataaagaaaggcggtagaaaaatggctactatgaaattaaccaatcaggaacaggtggaagactttgtcagggggtgcaccctgtacgcaacaggcggcggcggactcccggaaaacggaatcgtatcgcttatgagcgagattgagaagaatggaagcgtaggctggacggatgttgcggagattccggatgacgtattggctgtctgtccgttcctcatgggatccatcgcgcctcatgacgagtacaccataaaagaaatggaaggctttggatatacagaaggggtcaacaaagaaaaggagaggcttgccaaggcgattcaggaactggaggactatactggaaaaaaacttggagtcgtggtacctatcgaacttgcgggagccaatacatcgggtcctgtatcagcgggcagttccctgggcatgcttgccgtagatggagattactgcggaagggcaattcctgagatccttcagattactccatatctgaacggaaaggaatgcctgccagtgacttccgtggatgaatggggaaatacgtgcatcattaaggatgccgtgaatctgcgggtagtcgaaaaaatcggcaagctgatcagcgctggaggatatggcctggcaggacaggcaggattcgtcatgacaggcaaggagttaaaagagacggtgattccaggcacgctgacgaaagcctatgaagtgggaagatttatacgcgaggcaagggaagccggagaaacgcagatggtaaagaaactggcggagaagatcggggcttatattcttgcggaaggaacggtcgtgtcggtggaagatgaggatagagaaggatattactggggaacaattacagtacgcagcatagaagacgaagagtttaaaatctggtttaaaaatgaaaaccatgtatgctggaaaaacggacagccttatgtctccagcccggatttgatctgcatcgttgacaaagatacggcagagcctattcctaatccgaagatgaaaggagcgaaagaagtggcgattctggcgcttccatgcaagccgcagcttagagaggaaaagattaagaatgtactgtgtccgaagtattttggatttgaggatattgagtatgtacctgtagagactgtgatggaaggaaagtaaagaaagggtagaagaatgagagaaaatgcaaagcaggagatgcctgtggaagatcagttttatgattatccagacaggccggttcctgcagataagcgtaggacacagttaaacattgcggtagtgactactggcatggccgttgccatgtcaaccttgtataccggttcggcgctggctgaggtaatgtcttataaggacggcatcatttcgattctggcaggctgcgtcatcttgctggtgatcgccacgcttaccggaaatatcggggcggatcatggcgtttctacatccatgctggcgagacatccctttggaagaaaaggatcgaatatcgtaggcctcattcttgcgatatccatgctcggctggttttcctatcagtgcggctattttggggagaccatctcccttctgcttcccgggcatctgctgaccagtccggtggctgctacaatttggggaggaattttcatgatgtctacggctatcgtagggtataaggggatgacttatctgagcatggcggcagcgccgcttttgctgggcatgtgcctgtactgcggagtaatggcagtagctcagacgggaatgcagacaatcatgtcacagaatccggaacatccggcgggcattggaatagggatcaccatcgtggtgggcggctggattacaggcgccgtgctgcagccggatatctccagatatgccagaaacagaatgcataataccagaggcgtactgatggcaatcatcgtattcgcggctgccaactggggcggattcgtcatagcaaaagccacaagaagttcttctattatggaaggcctgcagtttcttggaatgggcacgattggtcttctgattgtcgtgctggggcagtggacgagcaatgataacaacctgtactcagctgctttggccattatcaacgtgaagcctggcatcaacaagcatattgtatctgcggtgtgcggcgtcgtatttaccttgctggcagtgacgggtatacagaatcattttgtgggatttctatctttgcttggaactttcctgccgccgatcggaaccgtgctcgtagcggactataacctgggcaggaaaaagaaagagtatcattttgaagggacggaaatctttgaggactataagccactggcctttatctccatcattttgggagggggaatcgcatacgtgattccttgggggtcgacggcgatcaactccatgattgtcacattcatcatttatgtagcaggcgataagatcatggcattggcaagttctgatgaaggagcagaaaatgaagcatgagataaaaagacggattgaccagtacctggagcagacggaaaagcagatgcttgacggaatcaaaagaagcgtacaaatacagagtgtaaaaggggagccttccaaggaggctccttttggagaaggacccagattggcgctgcttgacgcactaaagcaggcagacgaattgggatttaagacagagaatctggacagccggatcgggtttgcggagtatggggccggagaagagatggttgcggtgctgggacatctggacgtagtgccggctatcggcgagtggacgcatgatccattttgcgcagagatatatgacggcatgctgtatggcagaggcgtgctggatgataagggaccggtgataggcgcgctgtacgcgcttgccgcagtcaggcacagcggagtggacttaaaaagaagaatccgcgtgattatggggacggacgaggaaagcggctcgtcctgtgtcgcgtactataaagagagaaagcaggaacttccggtggcgggatttacgccggatgcctgcttcccggttattttctgtgagaaaggctgcctggtatttgaaatcggatgcgaactgtcaaaagagaccctgggaaggcttcagaaattccggggcggtaccgcgcctaatgtggttatggaggagtttgaaatccatatgctgacggaaggaggctcatgttccatgtataagaagggaaggagcgcccatgccgccgcgccttctcttggcatcaatgccggagtggctgccgcaaaagaactggcacaagtaagactggcacccgagatagacgatatgatgagattcattgcggattacattggagatgagacgcaaggaaaaggccttgggatcgatcatacagaagaggagaccggctgcgtatctgttaatctgggaattctgggaatccgggaaggccgggcatatctgacgctggatatccggtatcccaacaatgctgacccggaatggataaaaaaagaagtggaaagaaaagcaagttcccggaatctggaaatacagagcataagacattcgcctcttatgtacctgtccaaagaatctgcgcttattaaaaccctgatgaatgtgtatgagcaggagatgggagcgggagcaaagccggtcgcgatcggaggcgggacctatgcaaagtcattttccaatatggcggcattcgggccgcttttcccgggacagaaggattgcatccaccagccggatgaacaggcggaggtggaactgcttaagaaggccgtgcgcatgatggcgtatgcgatggcggaacttgcgcaggcagaggaggtgaacgaatggatgtaagtattttcagcgtgctgggacccgtgatgatcggaccgtccagctcgcatacggcaggggctgccaggctgtcaaaggcggcggccaggattgcgggtggccggattaaaaaggtctcatttgggctgcacggctcatttgccaaaacgtataaaggacatgccacggataaagcgctgcttgccggggtgctgggcctggacgaacaggatgagaatatcatccgcagttatgaattggctgacaagtcagggcttaagtatgaattttatacgacggatctgggagacgtccatgagaattcggtaaaaatggactttttgatgcaggatgggcggaccgtctccgtgactggctcatccgtaggcggaggagagatagaaattctggaaaaaagatatggcagcttgttttaaacgaaaaaggagaagatagaatgtaccataatttcagcgagttacaagattactgcaaccgcagccaagtacttttgtgggaggcagtactgaaaaatgaaatcagaattacccatgagccaaaagaactgatctatgacagggccagaagacgtctggcaattatggagtccgcggtaaaaaagcatattgccaggccttcagagccggacggaaactacatagcaggaatgtccgcaaggcagcatgatcacaaggacaatggcatctgcggcgcattcatcaatagggtcatggcctatgcgctatcctgcagcgaggcaaacgcttccatgggaaaggtatgcgccgcgcccaccgctggctcctgcggaatccttccggctgtcctgattgggatgaaagaagaactgagtcttgaggaagagacggttctgaatggctttatcacggcgggaggcctgggcgctattattacgcgcaatgccaccgtttccggtgcagaaggaggatgccaggcagagtgcggggtagcggcagccatcgccgcggcggcagccgtccagatgtgcggcggcaccgcagagcagtccattgcggccagcggatttgcactgatgaatattatggggctcgtttgtgatccagtagccgggctggtacagattccctgcgcccagagaaatgcttcccaggcagtaaacgctttagtgtccgcagatcttgcgctggcaggccagccgcttcttatccccatggatgagattgtagaggcaatgtatcaggtgggaaggcagcttcctccatcgcttcgggaaactgcgatgggcggccttgcagccacaaagaccggcaagaagatgggcagatgcctgacagaaaaaaaccttcaggccgaagcatagcatgctcagcctgaaggggaagcaggtagatgggctgccggattattttgcagccttatcagcaaaatctgttgtcactaggtcttcatacggcgcacgtttatccagttcgccggcgtcttccaggatatcctgcagaaggttgaaactgtcttcttcaaataccagattgtctttccaggtatcctgatcgtagtaacgttccacaatcgtagtaatcgtgtccagatcggtctctttaaactgaggggctatgatgccggcaatgtcttccggcgtgtgggactggacataatccatgcctttttgaagcgcattggtaaatccctggatgacttccgggttcttgtcaatataactctgctttgcggagaaggcagtgtatggcacatagccgctgtctgttccgagagaggcaacaacatagcctttgccttctttttcgaggttggtcgcgcctggctcgaattcaaccgtaaagtcagcctgcccttccgagaatgcggcagcagtagagccaaagtcaatgctctgatcgatatttacatcctttgcagggtcgatattgttctggttaaggatgtattcaaacaccatttcaggcatgccgcctttgcggccgccaagcacatctttgcctttgatatcttcccaggtgaagtctggcatctcttcccgggctaccaggaagttgccggcccgctgggtcagctgggcgaagttgacgacgtagtcgttggcaccctcgttgtaggtgtagatggatgcttcagatcccatgaagccgatgtctgcactgcctgaaaggacggcggtcatggtcttatcggcgccaaatcctgtaacaagatcgaggtcgatcccttcatccgcaaaatatccttcctcaatggctacatacatcggtgcatagaagatggagtgggccacttcatttaagatgacctttgttggctccttcttggtctcttctttctttgccttcgtatctgaagatgcggtttctgcgtcattcttggatgagcaggcaagaagagaggtcattgccatggcaatgacgagagatacagcaatgaatcgctttttcatataatcctccttaaaattctaatgctatagtatattcggctaagaaggatttgttaccatccatatagattagcagattacgatgatttttcgaggcgtggtctgcggcggaatacttctggttgtcgtggaatagtatacgattagcagctttcctccgagagagcattcgaagggctggccattggaagtcacgactggcgtgtaacgctccacattcaatttaagagacccatccagggcttccagattgtcatcgaagtagcctgcatacatagtctcgtacggattgcggcgtccaataaagactgcctggtattgtggtggaaatatgagtggtatgggaaggctggcatcatagaaggcggccacattcatgccgggccgcagacgtacttcattgatgacgtacgtgtccggcccgacgataaagttgctgatcccgtcagaattgcgtatgctgacctgccgctggcagcagtcatcgccaaatgctgtgatgtcctggattactccggtaattggaactagattcatagaaggcataattaatcccccgtttttgattaatatatgccgggattatttggattgttcttctggcttgatattggctaccttggcattgggaggaaggaaatggtacagatcctcataggactcaagttcctcaatggagatgggctccgaagggatcagtccggtacagtcctgcatggaagccgcattggacaagtagtcataatcatcaataattttctggtttttctcatctttcataagtatattacctccggttctttgcaaaaatataaaaagattaagattagattgtgtagaaaaagagaagggtatactgtataatatttccatgagtgtttagattgaagaaagaaggtcctgctatgaacattgaaattgacacgcatacccatacgctggccagcggccatgcatataataccctcagggagatggcggccatggctgccgaaaaaggccttaaaggactggccatcaccgaacattctccaaagatgcccggaacatgtcatatcttttactttcagaaccttagagtagttccaagaaccatgtacggtattgaactgctgctgggcacggagttgaatattatgaacgagcaaggagaggtagacctgccgcagactctattgaaggaaatggatatcgccattgccagcatgcatacaccctgttatgagggagagaagaccacggagaagatcacgcaggcatatttgaaggtgatggaaaatgaatatgtagatattatcggacatccggatgatggaagattcccggcagactacaaggaactggcgaaggccgccaaacggacccatacattgctggaggtcaacaattcctcgctccgtcctactggcttcagggtgaatacccaggagaactgcctgaagatgttaaaagcatgcaaagaagagggcgccatgatcgtgcttggaagcgattctcatgtggatgtggatattgctaattaccagtatgccgcagaattggtaaagaaagcggattttccagaagaattagtggctaattccagcctggaaaaattgaaggcttctttaaaacggaataaaaaggtatagactttacgaatttagtgtgttaaaatgtaacagtaatgaaatctgttacaaaggagataatgctatgagtaaaaagattaggactgaggcagtagattatctgtttagtgctatattaagtctgaaagataaagaagaatgctatactttttttgaggatatctgtacgattaatgaattgctgtcattatcccagagattcgaagtggcaaagatgctcagagaacataagacatacctggagattgcagagaagacaggtgcatcaacagcgaccataagccgtgtaaatcgttcgttaaactacgggaatgacggatatgacatggtattcgaaagaatcaagacaaaagaggaagaataaaaaagaaataaggctggcaggccttatttcttctttttatcctgaattggctcaggaagatcatcgattaatttttcaatcagcagtttctttacgtatacgtcgaaactcaggctgcagatgaatgcaaagaattgcaaataatcctgttctgtgccagggacatcggcaaaactgctaagcgcagcattgtaggactttgcaacgtccttttgcaggttctcaatccgggatttttccagtttgcagatctcttcgtagatagaagtaatattgaagtcctcgtgattatcgaaatatttctctgtgatgggtgccaaaagcgcctcgatatccttgatcgaaaggatatttttaaaatagtatatgaaaatcatgaccaggacatgctctttggaatatttcttctttaccggaggcggcagaagattattttttgcgtaattgttgatcatcgtcttagtcagaatcttatcgtccttatgccttttggtagactgaagctgttcctccataaaggtagttacctgatccatgtatagatctatattcgggatattccccggtctcacgtaatcaattcgcgagatgctggatagaatgctgttcagcatatcttttgtatcaatcgtcatgttaatcacctcaatatagatattatatagtattaaaaactagatgacaaggggtttttgcttctaagacagtttttgccagaacatttttattaggctttattttagagaccaatgttgatattccgattttcataggctataatggataaatctcaatccggcaagtagcagtttgaaggaagtgtcaagattctgggagcaggtagagcctatgatggaactatgtcataagaaaagtcaggaggaaatgaaggtatgagcgtatattcaatatatttcagccctacagggggcacggcaaaagtaatggacattgttgcggatgtgtggaaagcggatgcgcagattgatctgtccgtattagaagatgattatgagaactatcagtttaagcaagaagacatctgcctgtttggcgttccatcctatggaggaagggttccggaagctgcgcttgcccggattcggaggatgaaggctggcaatgcttcggcagtcatggtggtggcatatggaaaccgcgcttatgacgatacattattggaacttaagaatgaactctgtgaatgcgggtaccgggtaaaggcggccattgccgcagttacagagcactctattatgaggcagttcgcaagcggacggccggactcgcaggatgaaaaggaattaagggagtacgcccgcaagattcacgactccatggctcagcctggggatgtggaattgaaagtgcctggaactgtgccttacagggaatataatggggtgccgtttaagccaaaagcagggagcaagtgcaccagctgcggcaaatgcgcggcggaatgcccggtaggggcaatcccgaaggatgcgccgtcaacggtagatgaaaagaagtgcatctcctgcatgcgctgcgtggcggtctgtccttatggggcgaggacgcttggaaaggtaatgctgcttgccgcgtcccaaaagatgaagaaagcctgcagcggccataaggagaacgaattgttcttgccttagaaaattcaagaagggaatacttagagatgttaaaagcagtatttgtagactatacaggcacgataatacaggaagacgggccggatatccagcagctgatcatgcgggcttatcagaacagcaatatcgaaagccccaaggcaatggtggcttattggtggaacaaggtcaaacgatatgaggaggaaagttttggagagcggtttattacagaggatgagattgtagaccagattctggaagactgtagggaggagattcatctggaggatgacaagaatcagctgcatgaactgtgccgtcgcttctgggttcatgccccggcatttgacgacacggcagaattcttcgcaagatgtccgctgcctgtctatattatcagcaataatggcgtgaagtatattgaagaaagcatggcggaaaaaggactgaatcctgcggggatcatcagcggagacatggcaagggcatacaagccgcataaagaattgtttgagaaggcgctggagatcgctggagtgaccgccaaagaagtgattcacataggagattcggccgcgtccgatgtaaagggggcgcttgccgccgggattacgcccatacttcttgatcggaccgggaaagaagaggcgggggaggccaggattatccattctctgccagagattttggactatatagatgagtaaagtggatgattgaaaaaaggaccggcagcatgctttgctgtcggcccttttcgtgagggggattatccttcaatcgcaatatacttgttattttcgattgccttcttatcttcactctttggcacggaaagtttcaagattccattttcaaatctggctttgatgtcgctttcctctacattctcgccaacatagaaactccggctgcaagagccatagtagcgttcgcggcggatatacttgccgtctttatctttttcatcattattcttatctgtcgttgcgctgatggtcatatagccatctttgagttccgccttaatatccttcttgtcaaatcccggcatatcaatgtccaactcgtaatggtcgccagcatcttttacatctgtcttcattacattgttggatgcatgtctgcggaatggaaaatccataaagtcttcaaataaactatctccaaaaatactaggcatcaacataagtcatctctccttttctatctgaatgttgtttgttttatttgttctatatgtaatataacaaatataattagcactgtcaagaggtgagtgctaaattttataaaaaatgagcgacagaatttgccatcaaatatctgccttgcacttcttctccaaaaaacttataatagaaacagactttttggcggaggtgaaaacatagatgaaatctaccgtattatgttataatttgaaaggcacgaaaaagggaaagcagattgccatgatcttcggattccttggatataagatacgccatgtggagaaagaagaatatgaggttcccattggcgtgctggcgggggcaagcagccaggatcaggaggctgcgcagtatgaaggagaaggatttccggaagagatgctggttatgcatgccgcgacagaggacatgctagacaaggcgttattcctgatgaagaaggagaaggtacaggtaggcctgaaagccatggtgactgagaccaaccaggaatggacatctcttgcgcttcatgatgagatacagaaagagcatgagtatatgaaacagaggaaggaagaaaggaaacaggaagattgagtatatacgatacattgaatgaacagcagaaagaggcggtgcttcatacagaaggcccgcttctgatacttgccggggcaggctcgggaaagaccagggtgctgacccacaggatcgcatatctgatagaagagcagggagtaaatccctggaatatactggccataacctttaccaataaggcggcaggagagatgagagagcgtgtggacaaactggtaggattcggggcggagagcatctgggtcagcacgttccattccacttgcgtgcggatccttcgaagacacatcgatctgttgggctatgataataactttaccatctatgacagcgatgaccagaagacgctgatgaaagacgtatgcaagctgcttcagattgatacgaagatttttaaggaaagggctttgcttggcaccatctctcatgccaaggatgaactgatcacgccggaagaattccggatccgtgcagagggcgatttcagccagaagaagatcgcggaggtgtatgaggaatatgagaagcagttgagggccaataatgccctggattttgatgaccttcttgttaagacggtgcaacttttccagacgcaggcagatgtgctggagtattaccaggaacgcttccgttatatcatggtggatgagtatcaggatacgaatacggttcagttcgaactgatccggctgctggcttccaagtaccgaaacctgtgcgtagtaggtgatgatgaccagtctatctataagttccggggagccaatatcaagaatatcctgaattttgagcatgtgttcgaggatgccaaagtgatcaagctggagcagaactatcgctccaccagcaacatcctgaatgctgccaacgcagtcatccgcaataaccgcgggcgtaaggataagaccttgtggacggacaacggggacggcgagaagttggaattccgccagttcgataccgcatacgacgaggcggaatatattgtgggagatatccgggaacatgtggacaggggcgaatgtacatacaatgacaatgccatcttatataggacaaatgcgcagtcccgtatctttgaagaaaagttcgtgactgccaatattccatacaagatcgtgggcggcgtcaacttctacgcaagaagagagatcaaagacttgctgtcctatctgaagacggtagataacggccaggatgacctggcagtgcgccggattatcaatgtacccaagaggggaatcggtcttaccagcatcaaccgggtgcaggaatacgccgtccggcatgaggtgggattctatgaggctctgcgggctgtggatctgattcccaacattggcagaggggcgtcaaaactggaatctttcgtggcgctgattgagcatttcaagacggatgcgcaggagatgagcatttccggactgatgaaagaaataattgaagagaccggctatgtagaaagtctggaggctgaagacagtgaagaagcggaggcaaggatcgagaacatcgacgagttgatgagcaagatcgtggcctatgaggatgcctgcgaggaaatgaatgaaccgcccactttgagtggatttctggaggaagttgccttggtggcggatatcgacagcctggatgagaacagcgactatgtggtgctgatgactctgcacagcgcaaaagggctggagttcccgcatgtatatctggctgggctggaagacggaatatttccaagttatatgaccattacggcagatgacccggaagaagtggaagaggagcgaaggctctgctatgtgggaattaccagggcagagaaggcgctgacgctgacctgcgcaaggcggcggatgatccggggggagacgcagtataacaagatgtcccgtttcctaaaagaaatacccatggaactattgtccacaggggcagtctttgaaaaggaaaaagaagaacctgccaagcaggcagcgtatatgcaggccaggcaggcatttcggacgaaggcatttgcagcgcctaagccagccaggcagtttggcactccggccggagacgggcccgggtatggcgtaggcgaccgggtgcggcatatgaagttcggggaaggaacggtaacggcgatcgtggaaggcggaagagactatgaagtgacggttgatttcgacgggccgggaacgaagaagatgtttgcgacatttgcaagattacagaaagtatagatagaaaagatgaaggcggtgccgctctggaggagacggcatcgcctttactttaatagcgcatatctataaaacattgtaacagcatcctgctgctatctggggcctcagccaaaggaagagtctgccggatgatctccaacacagactttctggtgatagttctctatctcggatttccattggagggcatcctggctgccgctttccatctggcccaggacatttcccttgcggtcaataaaaatggtggatggaagagggcccagatcctttaagtataactggctgaattcctcagaatccagcaattgggtatagttgatgcctgcgctgtctacgatggcaagggaatctgcatcctttacgtcggtgacgccctgaatcagtcctaatatctggacgcccctaccggcatattcctggctcagcgactccagtatccccatttctttttcgcaggaggtgcaggaagaattccacacatttataacggttagttctgattgcgtgaaaaggctcttggaatccatttcatatccgcttaaggtcttcaattttatgttatcggagtccttttcctgggtcttctgctgcgtgtcgctttttgcggcgccatttgcaggcgtttttttattgtcggtgtcggttttcgcactgcaggccgcagtgaagatgattgtcgccatgaaaatagggaaaagtagccttttcgttgtttttttcattcatacacgtcctttctgttagtagaaatgttacagttatactgtaataatagcagttacagaataaaatgtcaataggattttgagaaagtatgtgtcggataaaaaatgttgattttggtataaatatatagtaatctcaaaatgatagtgttataataaatacaatatttgaacttgctatgatagcagaaaggatgtgggagcatgagtaaagtagaggatatcattgcagcaacaaaattaagcgagctggtgaataaaaaggaagaagacagccattgcaagactgttctttggattttggcaatcgtaggagcagttgctggaattgcagcgattgcttacgccgtatattgtttctttacaccggattatctggaagattttgaagaagactttgaagatgatttcgacgatgattttttcaatgatgatgatcaggtataagggttaacggaatagtctgagaacgcaatagaggaagcaggttggaagcctaactggtgtatagaagggcctcttgcctgcttttatcttggaaggagaagaagatggacgagcagtgttatgcactattgatagatgcggacaacgtatctgccaagtatatcaagcctatattgacggagttgtctaaatatggggttatcacatacaaaaggatatatggagactggacgagcacgcagaattccagctggaaagacgaactgctgaccaattccataacgccaatccagcaattcagctatacacaaggaaaaaatgcgacagattccgctatgattatagatgccatggatattttgtatacgaatgatgtggatggattctgcatcgtatccagtgacagcgactttacccggctggtaagccgcatcagggagagcggaaagatggtgatcggcatgggcgagaacaagacgccggagccattcagaaaggcatgtgataaattcacgattctcgagaacctgctaaatgagcaggagccgggaagcccgaagactgaggatacccaggatacgcttggcagggagaagattgagattgaagacgcgatcatcaagatgatcattgagaaccaggacagcaataaggctaccggcctgggcgaggtgggaagccgcctggtcagcctgtatccggactttgacgttcgtagttacggctataatatgctgtcaaagttcctggaggaattcaccagaatccagctggtcaagcatggaaatatcgtgtccgtagccttgcgggaagactggggtatgaaagaagacattgacggatatgtggtttatatcgtaaagagggctggaaaagacggcatagaactcagcacccttggcaataaagtatatgaaaaatataaggattttaagatcagcgattatggatatgcccagttgaatcagtatgttaagagtatagagcatattaaggtggaacaggttggcaccatattgaaggcaaaatatatcaagtaagcatagaggagaattacggcatgaaaaaagggcaggtatacgaaggaatcattgaatcagtagactttccaaataagggaaaggtattcctacctgaagaagacagatatgtaattgtaaaaaatggaattccgggtcagaaggtccgtttttccgtcaataagataagaaatggaaaggcagaaggaaggctgctggaagtgctggagccttcgtctttggagattacttcctcttgtcctcattttggacaatgcggaggatgtacttaccagaatcttccctatgaagaacagcttaggttgaaagaagcacaggtgaagggcatgatggatgaggcggtagagggagattactgctgggaagggatcatggcgagccctgtgaaggaggcctaccgcaacaagatggaattctcgtttggcgacgagtataaggatggcccgctggctctgggaatgcataaaagaggcagtttccatgatattgtgaatgtaagggactgccaaatcgtggatgaagactatcggaaaatactggcatgtaccctggattttgccagggagaccggacttccttattatcaccgcatgcgccatgtgggatatttccgtcatctgctggtcagaaaggccgtaaagaccggggagattctgattgatatcgtgacaacgacagaacatgacttcattgaaggagcaggaggaaagcaatgggtcagccagctgcttgcgcttgaactggatggaaagattgccggcatactgcatacgaagaacgatagcctggcggacgtggtaaaggatgatgggaccgagattctgtacgggcaggactttttctatgaggaattgctgggactgaaattcaagatcacgccattttccttcttccagaccaattcccttggggcggaggttctatatgagaagaccagggagtatatcggagagaccaaagacaaggttctctttgatctgtacagcgggacaggtactattgcccagatcgtggctcctgtggcaaagaaggtggtaggcgtggagatcgtcgaggaggctgtggaggctgcaagggaaaatgcggcgctcaatggcctggataactgtaccttctgggcaggtgatgtcctgaaagtcatcgacgaactgggcgaagtgccggatctgatcattctggacccgccaagagacggcgtacatcccaaggcgcttgagaagataacgaactttggcgtggagcggatggtgtatattgcatgcaagcctaccagcctggccagggatctggagatgctgcaaggaagaggctaccgggtggaacggataggatgcgtggatctctttccggggacggtgcatgtggagaccgtctgcctgctagtacggaaaccttgattctaggcgggtttgcgggattgtttggggaaaatggagttgtgtttttacgaaaattagaatggataagttaccgcggaagtggggatggggtaacgccatgtgagtttaatatgtagtttattatgggttttgccggggagtttgtacatcttggcaaaacccatacttttgggcaaaagggttactccgggtcaaaagggcggatagtaaaaagaaacggcattgattttgccgtttctttttacaaattatgtttgttaatacgtttttgcgccatttcatagacttcgtcatcttcgcgtgcacccattacgacaacaagcatattatcatcgtggcggataagttgataaacgatacgtagacctgcaccacgaagtttaatttttaagaagacggaaagattggtgttgtttttgtttcccaggagttttccatagccgccttcattttctggaagaggattctggcaaactttttgtatcgctttgcgaattaaaatcttttgacttccattcagtttttggaggtcttcgagggcttcaggaagatattttacattccagctcattcaaattcaatatcatccgtattttcatagtcggaagctgtaaatccaaattcctgatccacttgttcctgggagatagtagtggacggattaaaatgggacatacgctgtgtagcagccgccaagagacgggcatcgtttacctcatccaaaagatggatatattcttcaggggataggaggacacactcaggagagttatttttcataacaacttttgcaccgtagcgtttcacttcatcaaaaatttttcctgctaatccacgattgaattgagtaattggaattgtgttttcaattgcacttctgatagagctcataatcatcacctctttaaccgtagtatattcaatgtcgctataaaagtcaataaatatactgacaaaaatatcgcctaaaattagtgtgtacaattagacatatttttatgaattaacatttgcagaaaaaagtaagattattcagaataatcttactacaaaaatacctctgacattataaaaatcaaaggtattttcgtatagattgcgttggaattggaacgaaagaaatgcacgcctaaagattgaaggttgcaattataatttgaattatgggaaaatgatgatataatgttcctatagcaaaaaattatgagaagttacactgatgggaggttgaaacatggctgtttgttataataaattatggaaaattcttattgatcgtggcatgagtaaaacagagcttatcagagcggctaagattagcacaaatgccatggcaaaacttggaaagaatgaggatgtacgagtagaggttttggttaaaatatgcggagtattaaattgctctatggatgatattctggaaatcattccggaacaaacagtttaagataaggaggatatgctgatgagtactgttttaccaaagaaacaaatgtcagaagaagatatcaagttgcagtatatcacccctgcaatcacttcaaaatgggatatcaaaaaaataaccatggaaacacaggtaacagatggtcgtatcaatctaaaaggaaattttgtttttcgtgaaaaaccaaagcgtgcagattatcttttgtatttgaatgctaataatccgattgcagtgattgaagcaaaagataacaatcacagtatatctcatggcttacagcaggctatgacatacgctcagatgttggatttaccatttgcgtttagctctaatggtgacggttttgccgagcatgattttttgacaggaacagagcgggaatttgctttaggggagtttcctactgaagatgaactgattgcaagatataagcaggaatctggcatgactccagcccaagaatctgttatccagcagccctattatagtagtcaaaatacatactcgcctcgttattatcagcgtattgcaattaacagaactgtagatgctattgctaagggacaggatcgaattctgcttgtaatggctacaggcacaggaaaaacttataccgcttttcagattgtttaccgcatgttgcaaagtggtatgaagcgtaagattctttatcttgctgaccgtaatattcttgtggatcagtcaattcagcaggattttgcaccattagaaaaagtaattcataaaatcaatgttgcgaaggatgataaaagtattatcacttctcatcaggtatatttttctttgtatcagcagttagtcggagacgatgacaaggaacatttcagtgaattgtttacaccagacttttttgaccttattatcgtggatgagtgtcatcgcggctcggcgaaagaagaaagtcgctggagaaggattcttgaatactttaattctgcgacacagattggtatgacagcgacaccgaaagaaactcgatatatttcaaatacacattatttcggcgatccaatttatacctatagtctgaaagaaggaatcgaggacggtttccttgcaccgtttaaggtaatcaacgttatgactgatattggcgatggttggagaccattaaaaggacaaagagataagtttgggaatccaattgaagaccgtatttatacgaacaatgactatgactataatatcgttattgaagatcgtattcagcaggttgcagcagaaattacccattatctcaaaagcacagatcgtatgtcaaaaacaatcgttttctgtgccacagaggatgcagcagaacggatgcgccaggctcttgtaaatcaaaatgctgatatggtcaaggaaaatccggactatgttgttcgcatcacaggtagcaatgattatggcaaaaagaaactggattattttatctctgtttctgaaccatatccagtaatagcaacaacatcaaagttgttatctactggtgctgactgtaaaatgacaaagctgattgttttggatgaaatgattggttccatgacagaattcaagcagattattggcagaggaactcgtctgcgagaaaaagagggaaaaacacattttatcgttatggacttccgcaatgtatccagattgttcgctgatccggattgggatggcccgattgaagttgatccgggatttactcctggtggtcacacaccgcctcctaatcatggacctgaaccagggccaatagagcctccagggtctaaaaatccaaaacctattgtagatagaaatggatgtaaggttgaaatcattcataagacagtttctgtttatgatataaacggcaagttactccgtcaggagagtattgttgactatacaaaagaaaatgttcgtggtgaatatgcttctctggataattttattcaggaatggcgtaaggacccgaaaaaggaaaatattaaaaatatgcttctggaacgtggtatcgaccttgaaatgatgaaatcagatcaaggcttggctgatatagatgattttgacttcatctgtcatgtggcattcgataaaaagccgctatccagaaaagaacgtgcaaataatgtgaagaaaagagatttccttagcagatacagtggtgttgcaagagaagttctggaagcattattggataagtacatgaatagcggtatttatgaaattgagaaaacagagatattgaaacttgatccattcctgaagatgggcaaacctgctaaaattgccggatatttcggtggaaaagccggatatctgaaagctgtacaagaactggaagaagcaatttaccaagatgaggcggtgtaaactatgagtaatttatcaggatttgtaaaaaggctccgtgacattatgcgcaatgatgcaggtatcaatggtgatgcccagcgtattgagcagattgcatggatgctctttctgaaagtatatgatgcaaaagaacgggattgggaatgggaagacgaaaattatgaatccattattccagaagaatgtcgttgggcaaattgggcatatgatgataaaactggtacagcaatgacaggtgatcagctactgaattttgtaaataacacactgtttcctgttttgaaaggtaatgatatcaaagattctaatggcaatgtgttgatttatggtattaaggttgatgcatctacgcctatcaaaaaggctattgtgcagactacttttgccgatgccaatcagtacatgaaggatggtgttttgcttcgccagattatcaatgtaattgatgaactggatttgagtgattatgaggaaagtcatgcctttggggagatttatgaaaccattttgaaggaattgcaaagtgctggttcttccggtgagttctacactcctcgtgctgttacagatttcatggcaaaaatgattaatccgcagatcggcgaacaggttgcagattttgcttgtggtacaggtggatttcttacaagctggttgaaagagctggcggccaaggttaagacaacagaagatcagactgcatatgatagttccatttacggaattgaaaagaagcagtttccatatatgctgtgtattacaaatatgctgctgcatggcattgatgtgccgaaaatttaccacgataactcccttctgaaggatgtactggattacactgttgatgaccagtttgatgttattttaatgaatcctccatacggcggtaatgaaaaaacagaagtgaaaaatcattttccggcagatctggccagtagcgagaccgcagaccttttcatgtctgttatcatgtaccgactgaagaaaggcggtcgtgcggcggttattcttccggatggctttctgtttggtacagataatgcaaaggtggcaatcaagaaaaaattattctcagaatataatgtacatactattattcgtatgccgcacagcgtttttgcaccttatacatcaatcacaaccaatattctgttttttgaccgcacaggtccaacaacagaaacatggttctatcgtttggatatgccggaaggatataaaaatttctccaagaccaagcctatgcagtttgttcattttgaccccgctgtacagtggtggaatagcagagaagaaattacgattgatgtatttgacaaggcaaagaaatttacagttaaagaattatctgacagaacttataacattgatctctgcggataccctcatgaggaagaagaaatcctgccacctagggagttgattcagcagtatcaggagaaacgagcaagtttgaatgcagatatcgaccgcattctggctcagattacagaaatattgggaattgatttggagggagaataatgaccggacaacagctaaaaaactcaatattgcaaatggctgttcaggggaaacttgttccgcaagacctaaatgatgagccggcttctgtattgcttgagagaataagaaaagaaaaagaacatttcatcaaagagggaaaaatcaagaaagagaagaacccttcttacatcttccgtggtgtcgataatttgccttatgagaaagtcggcacgaacgaacctgtctgcattgcggacgaggttccgtttgaaattccggagagttgggagtgggtaagacttggtagtgttcttgatatagcacgtggtggatcacccagaccgataaaagattaccttacaaattcacctgatggaatcaattggattaaaattggtgataccgataaaggcggaaaatatatttgttccacaaaagaaaaaatcaagccagaaggtataagcaaaagccgtatggtttatgaaggtgatttcctgctgaccaattcaatgagttttgggagaccgtatatattgaaaacaagaggttgtattcatgacggttggctggttctgtcaaaccagtaccaatgctactcggtggatttcctatattatttgctatcgtctgcatttgcgtataatcaattttctggtgtagtaagtggcgctgttgtgaaaaatttgaacagtgataaagttgcagccgctttatttccacttcctccaattgaagaacaagaacgcattgtattaaaaattgaagaaattataccattgatagagaattatgattgcgcagagatggtgttgtcttcaatgcaaaagaattttcccgcccagcttaaaaaatccatcctgcaaatggcggtacagggcaaacttgtcccacaagaccctaatgatgaaccagcatccgttcttcttgaacgcatccgtgcagagaaacaacgtcttgtgaaagaaggcaaaatcaagaaggacaagcatgaatctgtcatttttagaagggataattctcattatgaaaagtgtggttctaaagaaataaatattgatgaaattattccctttgatttacctgattcttgggaatggataaggttgtctacgatattaacctccactgacgcaggaaaaagtcctcaatgtgaaaatcgccctcgaagtaattacgaatggggtgttattaaaaccactgcaattcaggatggctattttcttgccgatgaaaacaaggttttaccgataaatttcaatatacaggaatcaatgatggtgcactccggggatttactcatcaccagagctggtccacgaaacagaactggcgttatttgtgttgtagatggcgaacctgaaaacctaattctatcggacaagacagtacgattgtcatatctgcgtggttttgtgaatccctattatataatgaccgcattaagtagtcccgcaatgcaatatttcgttattgattctatgactggaatggcaacttcacaggttaatatttcacaagaaaaaatgaaaacattcttattgcctcttccaccatttaatgaacaacagagaattgtcgaagaagtcgagaagatatttgaacatataggtgcactgaaattctgaattttctcataatgcaggatatgagtatgcgaagggaatattcacaagtatgaaaaatcgagatgcagttgaagagaaatttttgaaaagaggaattgagattacgaaaaatattcaagagcatgaaggtctatatccgttgggctataatttaacaccatcattagggattgggacattttgtgcaactgacttaaatatttcaaatacatgtccaatagtattgtggtggagaaatatcattaagcaaggtgatgaattggattgttggtatccattgttacctaggagaattagcgacaaggatataaatccatttgatgcagattgggatgaggaagaaccagaagatgatggttatgacaatatatttgacacttgtccggattgtggatgcggtataagccttagtaatgatgatggtaatggattttgcattgattgtgcatgaaatcattaaagaatgcaaaatattttaatggggatgaagaggattattgatatgaagtataaaagaaaactttcatcgcatgttgaaaccgtctgtctgctgtccaagaaagttcagtaaatgttgttcagatataagcactgttgtggtcaaacttttttgtaacagtaatggctaacaaaattaagattgtttttccgttgcataccgtgcttcaaacagtgtcttatacttgttgtatgaatgcggaaggacgtggttatttgtcacgtatgcaaattcttcaatcgacgaatacaattcctcatctgtgtgatagtaatgtaaatatattaattcattttttaatgtattataatagcgttccatcggtgcgttatcgtaaggacacccagttttgctcatactctgcttaattccagctgacatacagaattctgcgaactcctttgatgtatactggctcccctggtcactgtgcaaaatgagtccctcttttaagtatggttgggattccaatgccttttttacagtgcgaatcgcaaggtctgcagtgatgctgcgatctgtaatacttgcaataacgctccggtcataaaggtccaaaacagtgcagttatagcgtttgcttccatccgtcagaaagagataagtaaaatcagtacaccatttctgattcactgactctgctgtaaagtcttgtgacacaagattatgaaacactttatgaggtgctccattctgaacacccggcttcctgcggcggacaacagagcagagccctcattcatggttcatgtatttgtgtacggtcagacggctgaagcatatgcccttccgttccagatatactttcatactccgatatccatcaattcccttatgttcatgatagatggaagcgatttcgtcaagcacctcctgtttccgggtatgataagcagacttccggtttttcaggaagttgtagtaagcgtttggcataatcatgaactttccaagaagccagcgcacgccgaagatgttgtgatatttttgaataaaccgataagcctctaatcgatttcctttgcaaagaatgccgctgctttttttaggaaaagtgcttcctttttagcttcttccagctctttacgtaaacgcagattctccttcattaattccatttcgttataagattctggatttactttggcttgatcctggcattctttactgaattctgtgcaccacttagagatgcttgctttggatacaccgtattcatcagtgatgcttttataggttcgtccgttttcgatatgtagacgaacaatttttttcttaaattctggttcgtaactctgtggcatggtagtccctcttttcttaatgagattattatatcttataagccacatgcgttacaactatactatatcacaacagattgacatgatcattacaaaatccatcagccgttttgccaggaatacattggactgtctcaaatatatccgggaattaaagagcaagaacattccggttttctttgaaaaggaaaatatcaatacgatggattccaaaggcgaagtgctgcttaccatcatggcgagtcttgcacagcaggagagccagtccctttcccagaatgtgaaactcggactgcaataccgctaccagcaaggtctggtacaggtcaaccacaaccggttcctgggatatactaaagacgaggatggcaggttggtcattgtgccggaggaggcagagattgtgaaacggatttaccgggagtacctggagggtgcaagtctggcgcagattggcgacgggctggaggcggacggtatactcacaggcgcagggagaaagcagtggctggcaaccacgatcaaaaagattctgagcaatgagaagtacatcggggatgctctcctgcagaagacatataccgtagatttcctctccaagaaaagagtgaagaacaacggcatcgttcctcagtattatgtggagaacagtcatgagccgatcattccccgtgagatttacatgagggtgcaggaggaaatggcgcggagagcgaatctccacagcggggagaaaagaaagaaacgggtttatagcagcaagtatgccctgtcgagcattgtatattgttcgaagtgcggggaaatctaccgcaggattgcatggaacaacagagggaagcattctaacgtatggcggtgctgcacccgtgaagagcatggtcctaaggggtgcgatgccccgacctttcaggaatccgtgctgcagaatggtgtggcaaaggcaatcagcgaggtttttggaaacagcaataccttcctcactatcctggaagaaaatatgcaggccgtcatcgggagcgatgtggagagtcggcttgcggagattgacatgcggctcaaggaactgcaacaggaaattctgaaacaggcaaatgcaaaaaaggattatatggaggtggcggatgaaatctatgccctgcgggagcagcggcagaatgtcctcgcagcggaagccgggcaggatggcaggcggcagcggatggaggagatgaaaatccttctggaggaacaagcggatatccctctggaatatgacgagcagttagtgcggagactggttgaaaaggtcacagtatatgaggatgaacttgttgtggaattcaaatctggattggagattcgtgtggaaatataaaggagaaaatgggtagtgccctgcggactggaaacggaccgtggggcgcttttttcgtaggggaaatactttcgagtggtattgtgtttatcaaccacaaggtttataataaagaaagcgatggagggagaatatgacaacatcggatatgattaggacgttatgtgaaaagcaaaatatcagtctggcagaactgtgcaggcgcattgggcagactccgcagaattttaataagaaactgaaacgcggtacggtttcttttgatgaaatgatggagattgcagaggctgtgggtgtgggatatgagcaggcatttgtgttgccggatggagagaggatcagaatatatgacgaaaaaatggattgataaaataccttatcttgtatttatgataggtgtaattatggatattggtgtaaatgtaaccggtattcactgtattactgtatcggaatcgtacatggactgtatatttgcaggcataataacggtttccatattatgctttacttttgttactttaatttcgagttttttggataatagatatctggggtataggttaaaggatgtaatacaatttccaaattctccggtgaatttgaaagggtatataaggatttccttattagctattattattggggtgtgtcttttgggggtgaattttgaatttgattgtgttaatagcatgacaactttattagttgcattagttttattggaaggaaatgttgcgttcaaaatttatgaaatgattaccaatgaagactatgtttttgagttggcaagtgagcatttcctagaaagtgcaaattataaagagatgacgctaaaagaatttcagtcacatacggatacaattttgagtgcgttgtcaacagctattaatgaaagaaattatgttgagaaagataaaacgtgtaagatgctcgagaaattgggaactcaggtgcaaacaaggccagagaaagaggggtattatgactattataagtattttgacgcgaaattaagggtgcatgtagatgattttgcgaaagtgttcggatataatgagatggttgaatctattttaagaatttatacgcaaatgagcaattttgaatatggaagaagtgaggtgtatgtaattcccttaaaaaatatgcgtttttggaatgaccaactattgttagagaacaattattttaagcaaatgatagaaattgatttgttggatatatacaaggaaaaaagggtttcaaatgctgaaattgaaagaattttttatgcgtatttcgagagtttaatgaataatagtttgtgtacagaaaatgttcgtaaacaactagtagaagaatatgttgcggccttgatgaaagtacagtggaatactaatgaaaaaggagtagagccagatattaatggattgttaaacatacttaaatattttgttctgaagaatagtaatgtagataatagaaattacatattccaagtaataatcaggcaggcattttataataatatgccatatagtaaagaaaaatattatgattttctttcattatttttccaagcattttatgcgtttatgttttgcgaaggagaaacgttgaatgagaattacagagaaggcttgaagaatacttttgtaatggagttttcttcggaaacaattgtaaaaatgagtgctccatggctgttgcggataaatattcaggaaatccttcgtgcaattggaaggagaattcaaagtaattcagatttgcaggaaagaaggtttgaaaatttccctttatttatgatggctaagactaccgtatggacttcagaatttaatgttgattttatgtttatactctacataatatttaatgatgaggttggattctacagtatctatgaggcttttttcgactggaaagttttaagtgatgatgataaaataaatatattaggagaatttcaagagcaatttgatatggaaacaggtttattaaaggagagttttgttactcggtgcaaaaaatatgaaaatttattaagacatactggtaatgttggagaacaagcacaaataaagctgtttaattatattgttaaagaatacacgagtttaaaacagaagaaaatgaatgaagcggagcctaaaatagaagagatagattacagagaggttttgacaaaaatagatgaactgatgaaaaatgatggtatattcgggtgggactcacaatattctacagaattttatgtgaagtttgtaatgcccgattgtattagtagaaaagaatatcgaacaactcaaagtacggctagaacaattcaaagggggattattgaatcagttaagagttatatacggcagtgtggcaataaattagttctatcctttgatatggaaggaattagaaatatgaatatatttctctgtaacaatagatatgatgctagaaattatacatatacagatgattgggcattggcaaaattcagagaagagtcagagtttatggaactagaagaaaagcagaaaaaaatcgaatttgtgggaactccacaaatttatgatagtctgtattttaacaaagaaaaattctgctttaatgtgaaaatattgaagatagaatttatcgatttaagtgaaaaggaatgtgcggaatttatagaaggttcaaaaggttacaacggactatataatatggatggagcactattgcctaaagaggaagccatgaagattataaagaagtcatattgtaaagagcgctatggtttcaaattgatgataggcttgaggaaagacgatataacctatatagattttgagcattaattttaggtcagtatagaaaaaggttgttcgatatgtttccgtggagtgaaaattcccgaaaaagcggtggttaagtttagtgggagtgaaaataggaaatgacgtacttcttagttccttgtgccatgttgaaaccgtctgcctgctgtccaagaaagttcagtaaatgttgttcagatataagccacagacaaatttcagtttgacagggagatttattataatttgagatgttatctatggttgacaaattgccaatagtagttgtttgcttataaagtgtactgtttgttataatcacattgtaagaatatggcaaacagctaggaggaagaaaatgaattttaacgaaaagcttatccaacttcgcaaatctaaaggtttgtcacaggatgaacttggcaatgcgttaggcgtatcgagacaaacaatatctaaatgggaacttgctcagagttatcctgattttcaaaggcttgttttattaagtgattatttcggtttatcacttgatgtacttgtaaaagatatcgatgtacaagatgttagaactaagaatctaaatgacaaacaaatatctgcaatttatgaggatataagttctgctaaatcaacgataaacaaagttgtaaatattttttgtgttattggggttgtcggaattatacttgccattttggcaggtatattctggggataacgataacgcccggttaacagggctgataagtttgaaggggagaaacattatgaaaatgccaaatgaaaaaattgatacaattatgtttgctccttgtggaatgaattgtttcgtttgctataaacattgttatcataaaagaccgtgcgcaggctgtttaaatggtgatatggggaagccggaacattgccgcgaatgtaaaataaaagattgtatcaaagtcaatggattgtctttttgttttgagtgttccgtatacccatgtaagctgataaaaaaccttgaaaagagttataacaagaggtatcaggcgagccttatggaaaacagtgaatttgtccgtcaatatggtttggaactgtttatggaagaacagaaagaaaaatatacctgcccgaaatgcggcgggattatttccattcatgacagggaatgtagtgattgtcaggaaaaattggagtagtgaatgtttggcaggaggtggttgaaatgtgggtttgcccaaaatgcggaagagaatttaaaaaccagaatcagtcccattactgtgggaaagcaccaatgacgatcgaccaatatatagatgcacagtcagaggaaagtcagccatatctgctggaagtccgaaaagcgatacatgaagcgattcccgaagcacaggagcgtatttcatggagtatgcctactttttggaaaggacataacatcattcattttgccgcaaataaaaagcatattggtatatatgcaggagaagaagcagttattgaatttgctgaaatgctgagattatataaaacaagcaaaggaacaatccaaattccttataagcagcctttaccgctggatttgatttctaaaattgctgtttggtgttatgaaacaggcaaccgtccataatctaatagaaagaactgaataaggaaagtacataggcgtttgtcaaaaatggcaggcgctttttctattcatttttgggagccggtaatggctcttttttttcgttgcggaggagcaggcggccaatgcggaggctctggtagggaagaacgccatgagcgggttcctggcgatgatgaatgctgcgccgggggatatcgagaaactgtacggggtaattacgaaatgttacgggacggcccagagggatgtggtgcggctgggggagcatcccggcggatttttcggtatctccgaagtggctgaaagttctgacgggggttaagcagaaggagaagattggtgtggagtattttgatacggagtcgctggagatgaaaaggacggagatgtttattgaggggtataaggcggggctggtgaaggatacgtcttttaaggggctgtggaaggtgtcgtttacgctgcgggagttttgagaagcggttgccggagggcgtgtgggcatggtatactttgaggagaaaaattagaattgaccgccaggtcaagaagatgggcaatgcaacaactttgaatttaggatggtaatagactatgcgaaaaattattttatttattgcgatgagccttgatggatatattgcagattcaaacggaggaactgaatggctgggagggcagatacctggaaaaaatgatatggtatcttatgaagaatttatccgcgatgttgatactgtcatcatgggggcgaacacatatcgtcaacttgtaaccgtgctgtcccccgatgaatggatatatcccaatcttgccagctatatcattacccattttcctgagcagtccaccgacaacatcaagtttaccatggaagaaccctctcagttggtaatgcggttgaaaggagaatcagggaagaatatctggatctgtggaggagcagacattgtaaagcagttggtacaggcagatgtgatagatcaatattttattaacgttatgcccacgattttaggcggcggcattcgactttttgacggactagaaaaagaaagaaaactaaaattaatcaagactaaaagctataatgggattacagatctggtatatgaacgacggataaatgccaggtgatggagctgaaaattagaatttatcgaggaggtaggtataaaatgacttgtaaaataagaaaatgggcgttatcggatgcaaaagatttagcggcggctctttcaaatactaaaatacaagataatcttcgagacggattaccttacccttacacagagcaagacggagtggattatatatctgctatgctttcagcagatgaaaatgaaacgtttgcatttgccattacgacagacagtaaagtaattggcagcattggtgttttccgtcaaggaaacattcacaggcagactgctgagttgggatattatgtcgcagaagaatattggggcaagggaatcatgactgaagctgtcaagcaaatctgtaagtatgtttttgacaagagcgatattatccgtatctacgcagagccgtttgcatacaatgctgcatcttgccgagtacttgaaaaagcaggtttccaatatgagggtacattgagaagcaacgccatcaagaacggtaaagttattgacatgaagatgtactcactactgaatacagaattgtaacttccggtttgtggctagaaaatcccagtttgcatacaaagaataaaaagttacggagaagaatcttatggattattcaacagaagaattgattgaagcaaagcggcagattgattcaactctgcataagctgagagagaccataaagacgtttgaagcaaaagaaaatgcttcccggtataaatcccagattacactggcaaaaaggcgggtaagggcttttgaaattgccaatcatttgattgaggctgagattgacaagaaatagaaaaaatggtttccagtgaatcactttcaacagaatagaattattttaaggcgtcagtcagaaatgattggtgctttttgtgtgtccgaaaaggaggtgctgcttttgtatccggtgagcgaggcgttcctgcaggcggtgcaggagaacaccaggaggtattactggatggggaggattaccacgaaggccggggtggagtattcttttgaaaataaggatatcgtgaaaggctccgggtatgcttccagccagtgctgcgggagtacggagctggagcttggcaccgtgtatgcggaggaggagacccatgtgctgttctttgggcaggtggtgataaatgttgctgcggagcaggtcagtaaggcgggtactgccgccgagagtattgtgattcctgttccttctatctattatggacggttaaccttaattgtagtaaactggactcagagaaaacatgtggagttgcggaggtgagcatagtggaaatccggtatattacgcctgctgatgacaaaatgacaatcagcaggatatatgaagaaagctggaaatatgcatataaaggcataataccacaggattatcttgagtcgcttccagaaggccgctgggttgcaaatttagaaaactcaaattggggtacgctggtttgtgttgatagtggacggattgtgggcacaagtagtttttgtgaatcacgttttaatcagtttaaagggtggggagaaattatttctatttacctattgccggactatatgggcagaggttttggtaaagccctttttcattcggttattgacgagttgaaaaaaatgggttatagaaatatttttttgtgggttcttgaaaaaaacctgagagcaagaaaattttacgaaaaagaaggattttcaatgtctgatgattatttagatgataacattggcggaaaagatgtgcgtgaaatcagatatatttacagagaagaatagtctgtaattcattgtgtggaataaaaaccgaatttgtacctgaaggcatgactgccccgcctgaatcatttataaaacagcctgaattacaggtatatttaacggatttcgggaagaaaaaagatgatgtgggtttgatggcggaaattcaggagcaagatggcagcagggagacgggcagcagggatttaagagaaaaaggaattattgaataaaaggaatgaaaagaaacagtcagattatttggtttgtttcttttttattaaatctcccgcagacaatttaatataagttttacctactgcgaactttgcaatggtggaagcatactgaaaatataggaaagagtattgtggatcagcaggatggatataaaaagcagaatatggcagcagattatttccaaatagtcacgtaatgggaaagttgttattagtctcttaaaaaaataagtgtaatgttatggtaatgattttctttaccgatgttgttgtcagagcatatggttgatataatggttaaagaattttaacgaaaggatttataagtatgaaacaacatcagatagtgatcaatgtgaataaatgtgtcgggtgcggtttgtgcagcaaggtttgtgtagcacataatcttgagataaagaataaaaaagcaggtaaagtaatggatagctgcataatgtgtggacaatgctcggctgtctgtccgaaagaggcaattgcattagagggatttgatgactgtcaaattgaaaaaacagaggatattcgccttgatccagacgctgttttgcatacaatccgatttcgcaggagtgtccgtaattttaaaaagaccaaaattccacaagaagtagttgaccaaattttagaagcaggcaggcttactcatactgccaaaaatatgcaggatgtttcttttgtcgtacttgataaagaaaaagaccgaattgaaaaaatggcggtcaaagtgttcaaagcaattaagccgatagcagatttgttcagtccgatggcaaggaataataaaatcaatgacagctttttctttttcaaagcccctgtgataatcgttatattggcaaaagataaaacaaacggtattcttgcagcacaaaatatggagtttgttgcggaagcaaatggtttgggtgtcttatacagcggctttttcacaatggcagcaaatatttcacggaaaatcagaaaagaaatcggtattccgaaagggaaaaaggcggctatgacattggtgtttggctatccggatgtgaagtatctgcgttcaacacctcataaaggcttagaggtcagatatatgtaggaggctttggaatggaaagggaatgtgaagaaaacctaaaacagattatagaaggatttcaggaatgcagaaatgcttttactgctcttggagatgaaacaagacagctgatactgcttaagttgctggaaagtgatttatcaggtatcagggtaggagaaatcgcaaagaaaacacatcttacacggccctctgtttcgcatcatcttcaaatattaaaggaagcgggcattgttgcaatgcgccgtgagggaacaaaaaattattattatttaagtgttgatgaaactgtgtggaacgatattgccgatttggtcaatggaatttatgaaagtatacaacacatcagttcacaatcataaaagagaggaaatctatgatattatatttttcaggaacaggaaacagcgagtacgctgcaaagaggataggaaaagaaatagaggatgaggttacaaatctttttgagaaaatcagaaccaatgattattgtacaatgaaatcagaacgaccatggattattgttgttccgacttatgcgtggagaataccgtatatcgtgaagaaatggctggaggatacagaacttgagggaaacaaagatatttattttgtgatgacctgtgggggaagtatcggaaatgccgcgaaatatcttggaaaactctgtgtaaaaaagaacatgaattattgcggctgtgcagaaattacgatgccggagaattatattgcattgttttctacaccgacagaagaagaggcattacagattatagagcaggcggaatgtgtaatagagcgcaccgcgctttgcatcaaaaataaggagaaactctctcagtcagaaatctcttttaaagataaaatgaacagcggaattataaataatctgttctatccggtatttgtacatgcaaagaaattttacgcgacagatgactgcatttcctgtggcaaatgcgtcaatgtatgtccgcttaacaatgttcgtatcgaaagcggaaagcctgtatggggagatcattgtacacactgtatggcatgtatctgtcgctgccctaaagaagcgattgaatatggaaagcatagccatggtttaaatcgttatacctgcaaaaaagaagtccggtaaaaggcttgaagtcacaaattgtgatttcaaaatagaaaagttgttgttgcagaattttaaaaatggtacatatacgctttctgcttatctgatagtacagttgggaaagaactttgcagatgttttgctgtttatagcactcgttgcgctgcttacggcactcgttgcgtgactttagcagatagacttcctaaaatgaaatcataaaataaaggaggttctatttatgttgaaatctatgggaaaaagtaagaagtgtatcttttggatggttacctttggactgatgggactaacgggagtgttactagctccagttgtaatgtacattataaaagtatcaaagcgctatcaaaaagcatttggatggatcaccactgctgcatttgttgttatatgcatattatatatatatggatttttatttaggcaggaatggaatgtgagttttgttccaatatgtatttgcatggttatggctattggcagagttctaaatagcaatattagatagtggaggagatatggaaatttcagaagtgataaaagaggccagaataaaaaagggaatgacgcagcagcaactggcagatgctgtatatgtcactaggcagactatttcaaaatgggagttgggaaaaagtatccctgatgaagcatcattaagtctgttgtaccaatgtttggagattgacaatgaagagaaaaaaatattaaagaaacttgcaattaataagcagaacgcatttttacttattatcgctattgtattttctccggcggtaatagggattcgctattgtttatttaaaatggggaaacttgaagatcaaagattcaagatttggattcaaagtgttggattcgttctgtttgctttttacttgagaactttgaaagataatatagcttatattttcgtttctataacagcaatttgttatttggcttatcaatattatatgcttagtctggacagagcaacggaataatgaggacgtagaaatcttagttataaaaatgctaagttggagcgtttgtcagagaatggcaggcgctttgagaattggttgctggatgggaagagggcatggtatactttaaggagaatacttagaatttgcaacaaagattgcttatattggaggaattaccaatgcaaaatttttttgaggcattagcaagtgaatgtaaaaacacagcattacctgaagagtttaattattttgaaaaacttattggcagttgggcaatagactatatagagagtaacaattccatttcaattaagggcgaatggcatttctcatgggtccttgaaggaatggctattcaagatgttattattctgcctgattatgaatatggaacatcgctgcgtatctataatcctgacacacacgcatgggatgtggcttatggttatactggaaaaataatacgacttgaagcaaaaaaacaagatgacatgataatgctcaccttcgtcaatgatgaaagaagaaagtgggtttttactaatatagagaataatcgttttcattgggaaaacattactgtaaaagatgatggagaatgggatataaatgcagaaatatatgctgaacgtatcatataaccacagttcatgttgatgcgtttgaaattattatttacaaggtatctagtaaagagtttagtatacaatgtgcatgtgagaactctctgcataaacgaatatcaaaatattattcggagcaacatatgtgacaacagtacttggcagatctaaatattatgcccaaagacgaagtccttgaaaaagatcaattggttggggcatctaataagggaacaatggtaattgacctgaaagataagaatgcttttgatacgcttatggcaagcccggctcatgtggaaactatggcgaatttgaatctggggaggtagttatgcttatcaattataatgagatgacggaaagaacagtaccaggaatgaacggtggaacaggagaaatgtcagccaagatgtttatggatgaacaagggaaaatcatcccttgccgcattcatgttggaggttccataggcttacataggcatgaaacaagtgatgacatcaactatacttacagttgtcgtagagcgataatcccaggctattgggataaaaattgagattgtaaatggggacgaatttatgttttaccgaaatgatgaacgggatgattattggcatatgggtgcagggacattaattaaaagcggccagccggatgacggtgtgatttccgggagtatggaactgtttagacagcggttcctgctcccggatttttgcaattcagaggattgttaaaagggttgtcttgattggtagatagaatataaaccgaaagggcattgaagatgtgtgctacaaggatggatggaaatactgaataatgaatgtaaggggaacctcgtgcaaagtttattccttattttgtttgaaggcaaattccttttaaaattgtgttgatggtaaatactatctttaaacacaataaggaggcttttcattatggaaaacaagacttatggatatgttcgcgtatccaccaaagagcaaaacgaggatcgccagttgattgcccttcaagaatttcctgttttagagaaatgcatttatatggataaactcagcgggaaagattttaacagaccacaatatcagaaacttctgaaaaaaatgaggcccggcgatctattggtagtaaaatccattgatcggctgggccgtaattatgaggaaattctactgcaatggaggatgattaccaaggagaagcaggtggatgttgtggtgttggatatgccgcttttggatactagaaaatctggcaatgatttgaccggcacttttgtggctgatctggtactgcaaattctgtcctacgtggcgcagacagaacgcgaaaacattcatcaaaggcagatggaagggatcgcggcagctagattacggggtgtacagtttgggagaccaagaaagccggttccagaattgttctggcagttaaaagaggagtggaaagataaaaaaatcacatcgcgggaggctgccagacagttatctatctcgcaggatacctttctaagatgggcgcacggaaaataaagtggtaattcggccatggaaatgtaggaaatatcggtcgttccttttacatagaatttggatgtttttcacgcctttttaggccaataggcgcaaatttatacccagaattattataacatgccggaacgataaagtctgatttatcgttcttcgtaaagcctgtgaaatgtgaagttaatttagtacagcagatgcagaattttcggttgtctgggggacattcggttaatcttttgtgaaaactttggcatattcagtgccgaactaagaatcatcacttgttctcaaatattactgtaccccaaaaaccagaagatattaagttattttgggggaaaacagtgaaatgagtcagcgacgaaaggtaaaggaagagaggtaggacatggaactgttagaatatctgcgcattcaaacagactgcatatatatctctgatctgagaggaagcaaacgataccattcaatctgcaacgcactctataggattgatgctcagcagtatagtttacaagaatggaatgatgctttgagttatatcacaagcaaatctgtttctttctcaaatcaagatgaggtcatagaatatttatcaagaaaaactagtaatgagttatttcaaaaatgaatattgaaatgagtaaaaagtagataataaattataatgcagagggcaagagtgtctgaaaatagagcattttgtaaagcgagatggggcgaaatatcagtggaatatggggagttatgtctgatttttcctatttttttaaccacgggtaggaaataaaatctttggaatagatctgcttcatctacaaataatacctctaaacaagatcaggaggtattacaatgaaagctatcgtatttgacggattgcagaaagttgaatgcaggaaagtggaagatccaagaatagaaaaagaggatgatattatcgtgaaggttacttccacggctatttgcggatcggatttacatttagtgcatggcctcgtaaaggggatgtatgacggatacgttttaggccacgagacaatgggaatagtcgtagatgccggaaaggaagttaggaatctaaagaaaggcgaccgggttgttattccgtttcccgtcgcatgcggacattgcgaattctgtgacagaggcgaatacagtcagtgcgacaattccaatgattatgcggaatcgggcggattattaggctatagtaaatatcacggcaattacgcgggaggacaggccgaatatatcagggtgccatatgcgaatatcggaccgaagaaggtaccggagggactgacagatgagcaggtcctatttgttacagacgtccttcccacatcctattggggtacggagattgcaaacgtcaaagcaggagacaccgttgttgtattaggctgcgggccggtgggattgatgacgatcaagtggtgtatccaaaaaggcgcaggccgcattattgcagttgatagggttgggtatcgtctgaggcatgcaagaggctatggcgtggaagtcttgaattttgaagagtatgaacaggtaggggaacacatcaaggaaattacgcatggaggagcccactgcgtaattgactgcgtagggctggatgggaaaacctcggttatggaaaagattgaaactgcgctcaaattacagggagggtcaaaatcagcgatagagacagcatcccagtgtatcagaaaaaccggtacagtggcgttggtcggagtatatggcaacaaatataataatttccctcttggaaacttcttttctaagaatatctctttaaaaatgggacagtgtccggcaaccagatacgttgatttgatgttacagaagattcaaaaaggtgaatttgacgcgacagatattataacccatacgctttcattagaagaaggaagtcacgcttacagtatttttgataaaaaagaggataactgtattaaagtgattttaaagccataataaaagacgtttaatctagctgggctgaaagttttttgtaaactttcagccctttggcaatcgatgtggtatgatatagtaaaaagcgagcgtaaaggagtgagcagcatgaattttgaaaatttgcaggcagcaagagagagttgcaggatttatagtgataaaaaggtttcgcgggagacactgacccatttggttgatgtggcgcgtatggctccaagcggttgtaattcgcagccatggcattttattatcgtggatgagccaaaggcacatgccaaggtggtggaggcactggatgatcatggcctgactggctgtccgtggggagcaaaggtgccggcctttatcttgatctgcgaagaagaggcacatctaaagcctggggttgcggagcattacggctcccagcattttgcgcagatggatattggcatggcagcgatggggctgtgctatgaagccacagcgttaggattaggaacctgtatgattggtacgatgaatcaggaaaaactgcaccaggcatttgagattccagaagagagaatcgtacgattaatcattacggtagggtatccggccaagaaaagcgagccacgcaaaaaagcaaggaaggatctggaggagatcgtaagctataatcattggtaaagaggaatctttttagtttcctgaaataaaaggccttggcggttttaactgccagggcctttcccatccgatcgccgcatcaggcgggcctaatcgattaaatgctgcaacaatataggtgatgaaaactgagacgaaatcgtgtgtattgtgttataatcagataagcatcaaatggcgcggacgaaaaatcgaaagtctatcgaatgaagcaggaggaatagaactatgagtgaaatattagtagcatatttgatcttgactggatgaataaaaaaagccggagcagtgtggagatgaatgataagtcattcagaccggcggttgctaataaactggaacatacagaaaatatcaaaattctgattcttgcttttcccatctggtggtacgttgctccgacaattattaatacgtttttggaacagtatgattggaatgacaagattattattccggtggcaacgtctggaagcagcggaatgggcaagaccaatgctgaattggagtcctcctgtccagtagaggtattaaaggatggcaagagatttgatgtcaacgtgagtgagaaagaaattaaagcatggtttacgaaggagaagcaactctaccgctggtaggtgttccttttatatggccaatctataataaaacaaaaagggagtcgatagacgaatggatcagattaaaatcggaaggttcatagcttcccggagaaaaggccatggatggacacagagtcagttggcagaaaaattaggcattacggataaggcggtgtcaaaatgggagaccggaaggtcgcttccggacttatctttgttcacccctctatgtgagttgtttgaaatcactttgaatgagttgctcctgggagaattgataccggacgactgcataaaagaaaaatcagaacaggtattgtttgaggttatttccagtttattaggaaatgaaaagggtcatgttcctgaactggagggccaggacacggttctgctgctggaaaatgtgacaaaagtatatgattccggcgacatatccacagttgcagtaaataacataagcctggaagcggcaaaaggaagttttatcgggatcatgggggcatctggttccggaaagtcaactttactgaatatgattgctacgattgaccggccagatagaggaacgattaagattgatgggcaggatatatcggatttaccggaaagttctctggcggattttcgacgccagcatctgggcttcatctttcaggagtataatctgttagatacactgaccattgaggaaaatatcgctttggctttgacgataaaagaagaggcaaaagagaagatcaaggatacggttcattcactggcggcggatcttgctataacagaggtactccataagttcccctatgaagtttccggcggacagcggcagcggtgtgcctgtgccagggcgattgttaccaatcccagcctgattctggcggatgagcctaccggtgctttagacagttatagtgccaggcagttgctggaaacactggtgatgttacggcgggactatcatgccaccatcttaatggtgactcatgatgccttttctgccagttattgcgaccggattttctttttgaaagatggtgaacttaaggattctttagacagaggggaaaaggacaaacagaatttttttgcggacatactggatgtcatggcgaaactcacggaggaggcgggtcatgtatcttaaattagcggttcggaatgcccgacgttccgtgatggattatctcctgtacatggtgactatgattgtgctgctttccattatctatatcagcaattgtattgccctgtggggcaatatacaggcaaaattccagacagcctctttaccattgctgattgtgctgattatggtatttttgatgtcatacattaacaattttatgataaagcagcgtgcgaaagaatttgcgacttatctgctgctgggaatgaaaaaagagaagctggctgctatgtttgcctgtgagattgcagttatcggactgatctgttttgctgcaggcatactgcttgggattttgtcttatgatttttgtttctgctatctgggaggccttggagatgagggtttttctgcagaaattataggaaaaagcatcttatactcttttggatatttttgtatcatcgaactgctctccatgttccgtatgaggcagacggtctacaagttacaaatctcccaactgatgaaggagcaacgccgcaaccagcctttaaatataagaagaaagacattctggctgtgcctgtttgcggtaagtatcagcgcctcgtggatcatggtttgtggaattgtattcctgccggatgatattggttacccattcatttctattatcagtataccaattgtaggttgtgtccttgcattttataaatggctgtatgcggtattatcttctataaggataaaagcgccggccagcctgtatgaagggaatcgtctgtactggatcgcggaaatgacttccgggtcaaaaaccagcgcagccttgaactccatattcagcctgtgcctgttgtctgccgcttcctctttcctgtttggagcaatcttattgcgtggggatatccgtgtgttttcggaaactgcacagaagtggatggcatttttgcagatgagcatctgtattattttcatggtgatatacttttccatcttgtcgctgctgcagattgtagagtggaggcgtcagggaaaggatatcaaggtgttacgctatatgggcaaaacccagaatgcattaaaaagactgatgagagatcagatcctggtaaaacttttcattcccacaattatgtgttttgttttgatttttagtatggcgccggctgtgaatcttagggtgaatcgtttatgttctgcggctatgccaaatttgttgttaaaatctgtgggggctttcactttgtgctttatcgtattgtatctttgctacttctatataacgtatttcatgagcaggcgttatataaaagggctggaatccaacaagaaactggagccctgaagtttctatatcatttatgaaatcgcaaatctaaggttgtaaggctgataaattagaatttatcgaggtacatttttgatacagaaagaaagggtcagatggaaacaaaatttttatttacacaattattggcaattttgggggcagtgctatattttctttcatatcagtgcaaagataattgcaaactttacgcaatgcagtttctttcatatcttttttatattgctcattttattattttgggagcgctgacaggaggcctcagttacatattaaatctggcaaggtcactattccttgcaagtaaatgggaatttgcccggagcaataaaatgtgtgtaattttatgttctatgcaaggtattgttgctatcacaacctgggcgggatggatatcacttctcccaatatgtgcaaatattgcatcgacaattggagggtatacgcacaacgctcaaaaaattcgaattgccggcatgttctttaattcgccactgtggattatatatgatttaattattggttcctgggcaggtgctatagatgaactagcgagcatcatatcggcaatgatttcaattcgcagatatggctggaaaaatttaaatcagattgatgattaacatatagcgacaacttccagtttaacaaactggacaaattagaatttggaggaagaaataataatgtcaggattagaagtgaacctagaatatatcgagcagcaaaccatatacggattgtggcaaaagtcaaatgataagactatttccagagatataaaggctctgtctaaacagtatcatgccgtggtttccatgccggagggaaaggtgttaccctattttgtcctgtccagaaattataataagcaaagccgcgatttggaattgtttattggcagtatgattgacaaaagcaatttagaaagttacgtactctcagctggcgagtacgctaagatcacagtaaagcctaaattgggctttttgtggggggcttctattggagaggcaaaacaatatttctatacaaaatggttacccaaaagttcctttgaagcattgaatttggaatatgagtatcacacagaacgaagcacggaaaagcaaccgacgattgacattatctttgccattcgacgcaaagcgatcgattaaaatcagacaaatccagtttaacaaactggacaaaagttagagtttgaaggggaatgcaaatgatcgaaagaccagccttagataaacatttagacagcaaaacatttcgagatttttattatctgaaagaggaattgatagatttctgcagaaaaaacggcttgcctgttgctggtgggaaattagaaatagcggatcgaattgcttattttctagatacgggaaaggtattatctgccggggcaggaaagaaaaaggctgcaattatttttacaattaccgaagatacggaaatagaagttgattttgcctgttctgaacgccatagagccttttttaaagagcatattggaaacagtttttcttttaatgtagtttttcaaaaatggttaaaaagtaattctgggaagacctacaaggaagcaatcagtgcctattatcagattcttgaagataagaaaaaagggaaatcgaaaattgacaggcaatttgaatacaacacctatatccgagatttctttgccgataatcaggggaaatctttggaggaagcaataaagtgttggaaatgcaaaaagcaattgccagggcataatcgttatgaacgctcagaccttgcagccttagaatgaaaaataaaattgggggaagcttgcgtccgtttttgatgaaacttttggttcacttagatgttttgaattgcgtcccacaggttttttagagagtgatcccccgcatatgtgtgaaagtttaacttgtaatgcgatagaatttgcataccagtatatattagaactcggaggagaggaacaacgtttagaataggaaattataagataggttttgacatatggggattaactttatttttggcaatgatgctccccaattttatatggtttgctgttcctgctgttaatgatgtgctaagggaaaaatcagtaaccccttttgtagatatgattgcttctgtttttcaagtcgtaatgattgtggcgctatgcattattatcaataaatatcgccagaagcctatgaaaaaagtagtgtttagaggaattgttattctattagcgctgtattacattggctggtgtttatactatgcaggaattataaatcctgcagtgatattagatttgagtttagcgccttgtttagcatttatattgttttcaatgtcaagaaaaaatgcaattgcgctattatcagcgattatatttacgctatgtcatgttctgtatggcattataaattttattatataatggcagtttgccatttcatctgtttcgcaatatgaatgctccaagtacttgtagcgtgaagcaattccatatgaagcacaattagatacagacaatggttctgatcaggaaaagacattgaacaaagttggaaaacagaatttgaaggaggaaaataagtaatgactataaaacaagttatgaaagggaaaaaggaatatatagacttgctgttgttggctgacgagcaggaagatatgatagataagtaccttgagcgtggtgaaatgttcgttttggatgacaacggcataaaagccgaatgtgtaatcacgcaagaaggtgatggtatttatgagttgaaaaatattgctgttttacccgattgtcaacgtaaaggctatgggaaaagtttgatagaatttctattttcccattatactcattgtaggacaatgcttgttgggacaggtgatgttccctctgctttaaccttttataataaatgtggttttacagagtcacatcgaataaaaaacttttttatagataactatgaccaccgaatgtttgaagatgggaaacaactaattgatatggtttatctaaaaaggacgcggtaaatcccagtttaagcaactggacgagcttgaatttgttagggagtgaaatacttggagtttagtgaacaattaaaagagcttagaaagaataagggactgacgcaagaagaacttgcaaacgatttataagtaacaattccgtaaagaagggtttgctgaagcgagaagttcatggaggaaagtgtaatgaaaaatattttggttgtacaaggaggcggtcgtgtcaacggcaataccagtcagttagtagatgcatttattgtaggcgcaaaggaggctggccatacagttgataagatatctttaaataaaacggaagtgaaaggctgtattggctgcaatgcctgccgttatgggaagccgtgtgttcaaaaagatggcttcaatgaccttattcctaagattaaaacggcggatttgattgtatttgcatctccattattattctggaccttatcatccaaaatcaaggcattcattgagagattttattgtatcgcggaggaagaccggaatccaccgcttgggcgatatgagaggtatccggtaaaagatgcggctttacttatgacatcggcagataattatttttggacatatgagcaggcaatatcatactacaaatttgcaataataaattatattggcttccaggataagggaatgctgcttgccgggggatgcggagataccaatggaaaaccgcagattgacaaaacaaaccatcttagggatgcttacaatttcggaaaaaatatttatcgggaatagtcccctgttcaatatacaggatatggagaggatatttacgcggagctggcattggacaattttagtgaaaggatatgctgatgaagattgaaacagagcggcttaagattgttgcgcttaccccagagcagcttgacctatggacgcataatatggaggaacttgagaggcggctgctatgctcgtatagggcagaaccaatggagggcctgttccgtgaaatcgtatgcggacaggtagagaaggctcagaaagaccctgacaattatctatggcacacgttttggtttattgttaagaaatcggataactgcgtggtgggctcgattgattttaaggacatgccagacagcgacggagaagttgaaataggctatgggctggggcgtgattttgaacataatggctatatgacggaatcggttcaggcattctgtgattgggctttggagcaggacggtgtaaagcatgtgattgctgagacagatgttgacggcatttcatcacaaaagatcttaaaaagatgtggtttcaaagaatatgccagaaataatacggtatggtggcggctataaattccagtcagtaaggctgacaaacgtcagaagaatatgaaaaagtatataattgcaatacggacagcaaagacagcaaggaaaagaggcttccttttgcgaatgttccagacagggaatgatatatgttttggaaaatatgatgccggaaaaacacatagaagtgaaaataatagaaaccgttttaagcggcgctgaaaaatgtagatttaaagttacgattgactagaaaatggtgagtccaaaacctatcatgatggaaaaagggtcatgtcaaataaaaaatagcagatgaggtgaatttgagattgaaagatattattgaatttcttgaggagaatgtagatggtaagacactgtttacaaaggaattaatatataaactggaaaatggtgcactgcaaggcgtctattctgatcagatatccttttctaaccttaagtattctcaaagcgggtttcaattggatatgttcattgtatctaatgagaaaatatggcttatgggagcagatggccaaagggaggaattacggaaagactttagcggcgtatccttatttcgattcgagttggcagagcgaaaaagtacgaatgccatgacaggctctttccgattgatttctgcttctgggaaaaatgtagcggcggaggctgtaataagtggtatatacgatattcgtcttgaagataatgtattaaaacttatggaagatcaggcgttgtatagggatcagccagtacaaggagggcgtttcaagcctgttgcatttcaatcagaacatcgtttttattgtaaagatggaaaattgcactatgaatactatggaaagtgttttgacgtgaatacgaaaacaatgcagcggatcgatagcccggatctctttccgccgtttctatcaatggaaaagtaggctgcgatatcaggttaaaaaaacagataggaagtatttatgtatgattgaggttgtatttcatgaaagcgccgcgggaagcctgaaattggcacaaggatatagaagggggaaattcaggacatcacctaaaagtgtatttgttggaagcggcaaaaatggcgaatcacgaggactgcttcgccaggaaaaggagcaggagcggcttgcctgtgaagaggcagtaccattcggaggaactgctgctgatatatttgcttttcatctgatgctgagtgtcggcgatatttccggagacggcgtttgcaggagacgcttagagacactaaattgcatgtttgggatgtatccggaaggggccggctcttctgcagcaaaagagatctttgacagagcctgcaaggacttggagaccatccggcagcgtttggatgccggtgaacaggtacgcatatggtacagcagccacccggatgagatgtgcggattacactggtttttgacacaacttgtccaggatatgccatctacaaaagtttccatcgtaaaacttccagattgggaaataaaagagcagaccctggcggtacatactggatggggtgaggttgatccggatgaatggcacaggtatgcaaatttgcaaaaagaggtgtccccagtttttgtgtctgccgctgcatcgaaatggaggcagctgcaggaagagaacgctgtattgcgcgcagtaattaacggaaggctgttcagtgtaccggaagatttttacgatcattttataaggagcgagatagaaaatcagaatgatgaattccaggaaggacagctgatcggaaggatattagggaaataccagctaggtatcagcgatggctggctggcgatgcgtatcgaaaaaatgattgaaaatgggaaactccagattatcactaatgcgccatccgactgtcctgcgtatcatcgagtgatcagaaaaataacttagaaaaaagattgcctttgtaaaaggacaattagatgtcggtttcggaaatggggcatttactcaagtggtttctgctacattcccaaatagcaatattactgctattgacacttctattccccaattattttcatctgacaatatagcatttactgaaggaagtgttgaacaactgtcatttgtttcagaatcgtttgatttagttattaccgtgctgtcgttacatcactggaaagaaaaagacaaaggcattagcgaaatatatcgagttcttaaaaaagatggcagacttataatcggtgacccgttacttgaagattggatgagcaatcgtattcttggatcattaatgcaagtgttggatggtggcgtctttacagataagaaaagagtaagtgaatatttaatcaggtcaggatttgaggacattagcattagacctgtccctaaaacgatgaaatcgctatatcttattaaggcaaaaaagtaattcaacctccagaaaggtatttgcagaaaaagcaaaactattgttcctttcgtcagcagcggattttcaggaaccctcacaacgattgcggaaatggaatccggtctgggattataaaagctggcttgcagaatgtaaagttctgaaagtcagctttttaagtggcatttgtgtactgtggcatatgttctttttgcagttcgtactgcaccatcacagaagtatagaagatcccctctttccattcaaagcgcactgtgccgtggtaacgctctgcgatatcctgcatggaagatgtcccgatccccatgccgtcgcgctttgaggatatcggcaagccttccttgaatataacaggagtactgcatgtattgtccgcaagaatcaggatttccgaactgctgcggcgcagaactctgagtttgatgaaattttgaccttctgactggcgctggcaggcttctactgcattttccagaatgtttcccaacagaacggtgatatctgtttccgatatggaacagacctcaggatagtctgccttggcatcaaagcgtatatggcaatccctggaaagagctgcataataacagatgatggcatttaccacgtcattgcggcagtagagttccagcatatcaggcggaagttcgctgcggtataggtcgatataggttctaagccctgtcttatcatccttttcaatataagactgcacgaccgccaggtgctggcgcaagtcatgtctggctctgcgcatatcatccatgtgccttgcaaggctgtcgaactgcttcttctgtgtcagtatgctgtggttggcgtatttcagcgcttcttccagctgggtacggctcttggatatctccagcacttttagcgccacataagacacatagcatgtgccaaacagcatgagatagcgcgataccatgaactgccaggtggcataggcatagacatcgtcactgaagcagtacagcattccaaacaatgacgagaacagcggtatcttccagaggtggcgccacatcgtctcatcctgtatctttatggcatctgtaatcgtatgcctgaaaaagtggaacaggaaaggacaggtcagcaggtatacaatgacgcgggcgatgttgtatacaagataaggatgctggtctgaaaaatcccagaagaacctgctttctatgtagttggcgtttccaaacacaaagaacgaccaggcaaacagcaataaatatgtgaacattagttttgaaaaactttcttttatgagtgtaaaggacaatgtcaggttgacgatcataaagccgtagcgcatgatggtcgtccactgcaccgccatctcatacccacctctgttgatgaggtaaaagcacaggctgttgagcgttgccacagccgttatcaataccaagacatatcgaaacgggatacgcagcttctccttgaacatcaagtagcgtggaatcgcaaaagggatgaaatcaaggtatggaaacagtatcaccatccatgtatctatcacagcagttcctcctctcttgctttttggaacagataggtatgatagtcgctttctatcttctttctgtccctctttgaaaataaaactctctccccattcgtcagcagaaaatccagatcgtctatgcgctctacgtggtcaagattgacgatacatcctttatagcaagtcaaaaactgagggtagtccaataacttgtccgccactgcgccaaaggatacccggaagcgtagaatccctcttcgatgcgtgtggatctggacgtaatgtccatccatgtcacaccagaaaatctcacgcagcagtatcttttcatcctgcacgcatataaaacgggcatttcgtaacctggctatgccgagctggagcatggcctgttcgaaatccgcataggagaatggcttcagtacatatccgcctgccctaacctgatagctttctatggcgtggtcccggctggtcgtgatgaacacgagtgtaacaaagttatctctctgcctgatctgccttgcagtatcaatgcccgagcgtccctgcatgtactggtctatgaatatcaggtcgtaggctgctttctggaatgaggacagaaaatcttccccgctggaaaattccgtaacgcagggagatccatcatcataatgctccgaaaagaaccggcgcagacagacatggatttcattcctgcattccaaaaggtcatcaatgatcgcaattttcatgttcagtcctcacttccttgaacgagtcaaaatgattagtcaatcctattttacacgaaaaaagggcgctgaacaatgtaagttgaagccaaaaagtgtaaaattcggccagcctattgttgtatccctgtcttttgatatggtaaagacaggaaataaatgcgtaggaaggagtgagaatgtatggaaacaattatctgtgatcctgatgttaagacgaattatctgatagaaaggtgtgtccgtaactattacaggaataaagatatagacgtacagatacgcagctgtggggactggcaggaactgtgcgcagaaatcaggcggcgggaagcggatgtgattatcatagcgcagagcggagtaaaaggactggatatcattacagggctgaatgtcccggcaggtaagatcatctggttctctgatctggactttgcggtacaggcataccgcctgaacgtttcctactttaatctgttacccgtcacgcaagagaagatatcccatgctctatgtcagattgagacagcgataaagtgctgatgattggtatggcgggctgtgttgcaaaactcgaagtacaaaaagggaggatatgaaatgaaactaaaaacattttataaagcaatgatcagcgcaggagtatttttactattctgcacattcccaggcgcagatgtcaaagcaggggacacggcagaaaacatatactgcaatatcagctatgaatatgtgatcaagtcggccgatggaaccaccgccctggcggatggggatgagaaggcgaggctcgacaatcagaatagtgctaaccctacatcatatgatccggagtatgcggcaactaaggaggagctaaaactgcaggcatttgatacagagcgatattatgattttaagggctggtatgagacccaggagaaggctgaggaaggaaaggaaaccgaccaggtctggtccattcccagtgatctctcagaggaaaataaaaacaaagatattacactttatgccagactcgaagagactgtttataacatcgcatacatactggatcccggagactccgagaatcccggtccggaccccaacgaaatgggttccaactggaacgacgagaggaatccgtctacttataccgcgaaagatgttgacgcaaaaaaactagtatattcggcaaagaatcagttccgtaccgtgagcggcgtgagatatctggcggcgtcgttttctggctggcacacggaaggcgaggaattggcaattgggggttactggctcaaactaccggataatggaaaaacattgattctgtacgcccagtacgcatgcaaatggatattctatgatccagaagtagcgctcatacagcagacagtgaaagaggggaaagtggcattaaacggcatgatctatcccggtgcgcaggtctatgcctctaagtacaccctgccggatgacacaaaggaaaagatatgcagcgggctttcaaaggacggggaactgctgggcgcttaccaggtccggcttctatgccccgcgaacccactaaacccaaaggataaggacccggaatcccgttgggacgtgcctcatgtaggcgacctggacctgactttgcaagttgctatccccggcgcggcggcattcgaatccgacggattcaaactctgccggatagaggcagaccagagcttcacctgcataccccttaagaagtccaaggaccagggaataggcagtgagggaacctggtatgaggcaaaagtcacagccctcaccgaacgggaagctgaccgggcattcgccgttacaggaatacggagggaagagacaaagcctgtaccggacgatcataaaagtcctgacaatccgaaagggcagggcgccaaatcagatcctgccaagaatgtaaacaaaagcaatacagtgaaaaaaacaaaagtagttaccggagacgacagcaatgcaggggcgttgctggcagttatggcctgtgcattggcggcagccggcgtcagtgttgtaatgcgtaaaggcaggaagcggaaccagcattagggcagaatctatggaggaaatgactatgaaagttattacgataataataggtatcttactgaccgtcggaggatttttctgcatattccgtccgggaatgacatttctaagtaccggctggatgttaggtcttatgctggtaattgcaggcatgaatatgactgccgcctatataccggggaaaggccgggataagaaaaaggacacggataaaggcaatctgctgtgcggaatcataatctcagtgctgggactgtttctgatcgtgagcggtatatctcgtgctgtggcggacatcataatcctctatgtgttcggggcaggcatggtaatcagcggcctgcttaagattagcggaggcctgtttcagaagaagaaaagaatcagggagtggggatggagcctggcatttggcatactgaccatatgccttggagtctactgctttttccatccgcttgccagcgcctacgcaatcggatacatacttggattcattgtgctgatgcagggattcaacttgatcagtctcggttctaatctggaataaaacggtaaggataggaaaagttaggaggaaacgcctatgaagtatagaaaactctggtcctgcatactgacaacagcctgtgtggtaagcctcacagcatgcactgccgctaagggcaatgaaaacaatgatcaaaaagacagcgcgccgtcagaggctggaaagaaagcggcggacagcgcaaaaaaagccactgacgtcacaaagaaaacaaacgaagaagtctataccctgctggacttcgacgaccagcaggaactggaatctgctcagaagaacctcatcgtcgcccccgaagaactggagatcaaggacgacagcggcaaggtggtgtggagccagaaagcatacgctttcctggaagatacggacgcgcccgatactgtaaatccaagtctctggcgccacacccagatgaaccatctctacgggctgttccaggtgacagacggtatctaccaggtgcggggatacgacatgaccaacatcaccttcatcgaaggagataccggatggattgtctttgatcccctgatcagcaccgaatgcgccaaagcggctctggaactggtaaataaggagttaggggagcgccctgtcatgggcatcgtcatgagccatccacacgtggaccattacggcggcattaagggaatcatatccgcggaagaagtggcagagcggaatatccccatcatagccccggagggattcgaggaacacgcggtcagcgaaaatgtatacgccggcacagccatgggccggagggcaggctatcagtacggaaccatactggaccccggtgagacaggctccatggccatcggcatcggaatgggacagtccaccggcaccatttcctacctgccccccaacgacagtatcaaagccaccggcgacacccgcaccatcgacgggatagagatggaattccagatgacccctggcacagaagccccggcggagatgaacacctggtttccgcagaaaaatgccctctggatggcggaaaactgcacaggcaccctgcacaacctctacacacttagaggcgcgcaggtgcgggacggaaacgcctgggccgggtacatcatggaggccctcacccgctacggcggcaaagcagaggttgtattccaggcccacaactggccccactggggaaatgacataatcacagaatacatgaaaaatacagccgcagtatataaatttatcaacgaccagactttaatgtacatcaaccagggctatacctccgatgagatcgcaggcatgatcacactgccggagaaactaagcgagatctggtacacccgccagtattacggcaccgttgcccacaactccaaagccgtataccagcggtacatgggctggtacgacgccaaccctgtaaacctaaaccgccttgcccccacagaccgggcacaaaaatatatggagtacatgggagacgcggacgaggtactgaaaaaagcgaagaaagactttgaaaagggagaataccagtgggtggcggaagtcaccaatatgatcgtattcgacgacccggataaccaggaagcaagaaacctttgcgccgacgctttagagcagctgggctaccaggcggaatccggtacctggcgcaacgcctacctgtccggcgccagagaactaagagaaggaactattaacgaccccgccgtaaaagctaccggaagtttcgaacttatgcagtccatgagtccggaaatgatgatggattacttagggatcctcctggatgccaatgccgcccaggacctgaacttaaaaatcaacttggacttcacagatgaagaaccctacctgctcactgtagaatccggcgtggtcctctaccagaaaggggcaaaagccccggatgctgacgccacactcaccatgccccgcttagggatgttctctatcctcggcggcgacaaagaacagcagaaaaaagccatccacatagagggggaccaggatgtgattacaaaactcacggaacacatggtagaattcgaatttttctttaatataatagagccttaaatcaggcagcacaaggagaccagcttatgaaacggaaaaaatattggaataaatgggttacaggagtcattctgttgttatgcagcatgttcctctgcccggatgtcagggcagagggaaacgagaatctcccggacaatccttatgtatacgcagctctcaccagggaggccatcctggcctgggatgttcccgacagtagtgagtccgggtcctactcttataccctgtgtgagaaacaaggggacggaagctatgttcccgtggaaaacgggacgggaatagatccgtcaaagggctatttcaccctttataaactcaagcccgatacaacttatacatttgcttttcagggtcagtccccaggaggcggcagcgtgatgggagcagacatccatctggcaacaaggcaggaaaatacactcagattttcccaacagccagaaagtacaacgactcaaatagggggattggcggcatttgaggccactgtccgtggcgagataggtaaaatggccgaaacgatcctccagtggcaaaagcttgacaatgacggaaactgggtagatatcgatggagcctgttcaagggagctagggtataatgatataatagccatatatccaattcactctgtttcccaggaagacgcagaatctaggtaccgggtccgggtgaccaggtattatgggaattcaagccagccctctgtgattgactccaaaagtgcggcactgtatgtgggagaggggccctatgacatagacctgcagatccaggataagccagaggaggggatttttacctacacttacctggatagcaccggaagtctgcgtaatagaacagccgtgctgattgaacctgtttccgggatttctatcccgataacggcggaaattcagggcgatcagaatacagcgttcaaatgggaagccactatgttctacagggatacggcaatagctcaggaagcgtataatatttcggaggacggcaaggacggcaatgtaaggtgcccagccactatgttacccggaggggcgctctccgggaaggaggttaagctgaagggagagcttatggataaagaggataaggttctggcaagttctgacctgaagccggtaagcatgctgaaacccggcgctgacaggtatgcattattgtatgatgtaaacggaggaaataacgcaccggagaatctggcttatatcggcgcagaggcggtggggattaccctgtatgcccctgcaaaacaagatagtgtatttcagggatggcggtttgaaggctcccaggatctgctccctatggatgcggacagcctgcagacctatcttacggtcgaagagatcaaaggggcggacataaaaggaaataaatccattacactggaggcagtctgggcggacaaggagcacgctattacttatgcaggcgcggacggcatagtcaatccaaaccctgccgtgtacacatcatacagtaatgtggatcttgcagacattggtaaggaagggtatgagtttgccggctggtacgaggatgaagcgctcacgaagcagatcagaacgattccgggggatctatccccggaaaagaaaggacaggacatcaccctttacgccggcttcagcccgctgaaagaaggagacggtcctggcggcaatacagaccctgatatcaaaccaacccctgtccagaatagcaatcaaggcaatggggcaaagaacacaagtgtatctaccggagataacagcaatatgtggacgcttctggcggttatctcagcagcgctggcagttggaatcagcgcagccgtgtataagggcaggagacgtaagcagcgttagaatatcaacactaccgctgcagaggaaggggaaataaaaatgaaaaagaagtacaaaatattcgctgcccccgcattcctggcggcagccatagcaggagtcctgatagcagggacgataccaggcattccaggcgtcttcaccagcaccgtacacgcagaaggcgaaggagaaagcggcagtgactacgacaacgaatacaacatgctaagtgacgaggggtacaaggacttctccttagacatcacggacccggcagaatttacttccgacgaccatccacttgagaactatgaccccaatccactgtcatggctctatgtggccaccacgaaccgctacaccaatatgtccaacaaaggagactttgcggtctataacaccatgccctttctggatacaagcaatacacagaaggccaccattaaagatagcgaccacaagatcaatggcgaactgcagcttaaccccatatcagccatgcgcggccaatacacgcccagttcaaatgtaagcgttgagggctacaagccgaagcagatagggcagaacgcggtatccataagaagaggggtggacaaagaagaagcgatcgtgcaactcttcattgattatgccgagacaaaaaagggctcccaaaaatacaaagaatacatgcgactgaccctcctcgagcgggagaaagacacctataacctaaagtcagagaacatatttaccctgacagaaaccgcagtgtataaaaacctggacacccgcgccatgagcgcggtcaccgctatgacagccgtagatttagacggcgacgggagtgacgaggttgcaatctacatggcggaccccgaacggccgagaatacagatcttctccatccgtgatggcaagatcgaggattacatacctggcggcggcagccaatgggaaaaaaatatcattgacctctcaagactcaatgacccttccgactcccaccagttcaacaaaggagccaatagcgaaatgcccatcgtaagcctaagtgccaccaggatttccggggaaacagccgaagacctggtcataactgcatgcgtaccctggtcacagagtcagcgctccatgaagtccgcggtggggatcttcggcatgtcaaaggacggtccgatagaaaaattttcctgccatcccgagtttcagtcaaagggcagtaattgcttcctcagatacccttccgccacagacgcggacgtagacggcaaccaggtaaaagaactggttatcggcgggtatgaatcctttaatggcagacaacttggagggtcctatcagttccagttcattatctggaaagacggtggctaccatctgctctccgatacaccggcggcagtaccgatctacaacacaagcagtataagtatccatgagaacttcagcatggccgccccggcggtactgtctgctgcccggctgaacaaaagttccgataaagactacctgctgatcgaaaatatagtggcagaattcaagccagcagaaaaagagacgaaaacagatccatccagcgatggcaaggatacacccggcggcacgaacatcaccgacgacggttaccaggcgcttcgtgtcggaacctttgagcagaaactggagataaacagcaatatagaatcaggctgggggcagaaccattacgtggcacaggccgtcagcagccatttcgtacagaacaacgctgccgccgagcagatcgccctggttattgccgacaccaacaccacaagtctgggacataatgaggtcaccctaagcattgcatggctctggatggaaaatggcaagatcgtgcagtataacacaaacccccaatacatcaagcggcgcggggcaaatgaatacggcaccgccctgatcctctgcccggtagccaacacctccaccgctgattattacaaatacatgggcaagaattacggctggaccatgcccacccccttaatcgccacagcagccattccctactggaaagaactgcagtatggaggttctcccggcaagaccagtttccaattcgcaaacacagtctcacaaggagctgatttccaggtgacgcttaagggctccgttaatgtggatgtatcgctgcaggtaggccttaagtttctcggcgaggaactgcaggtaggcggaggcggaggattagacgtcggcgcccaggtagcaggaaaagtagcgctttcccatgagaagacatccagtgtcagtaaagaaggcagaggtgagaatgaggaattatttgtctacgcaaggccggtcatcaattatcattacaaaaaatatgtgcccgaaacccaagtgactcaggaacttcttactgagtacaaaaagagaacaggaaaagacgcggagatagacggcgcgccggtaaaggcaggggatgtcatagaagccggatggtatgactattatgtccttaaccagctccccggctcttctagcatgatggacatggatacctatacagaactatacaataaatacaaagcacagggacagaaggtaacagaagtgaacctaaaggacctatactatgattatactatcggggatcccaccacttatccctccagccgggacaagataaagacctggataccaggagagggacttaccccgctgggacagttttccccatcgacggtaatcagtccgggaaacggacagactacctcaatcagcctaagccagagcgtgggagggacattggcagtatcgttggggttcgacatagattctaagacctatgccaagggacatgcagatctgggatttgtagccggcggagaagtcgacggacagatcgggtatacggtaggatcaagccaggaactgggggcagaactctcactgtccgtaaacggcgcaataggagtcactcttaattccccggatacgaagaatacagcctaccaattcagcaccgccatggcggcatgggcgacgttcagaaaagtaccggttgccgtaggcttcactgtaacgggaactgagcctggcaaagaaatgccgcttccacccttgcatccatacgtgtacgccaccggaaagacctgggccatgctcgcgtgggatcagcccccggagggcggccgctgggcggacggttataagatctaccaggacgacgcagcaactccactgaatggtgggaaaccagtagatgctgctgcttgtcattaccttgtgacaaaccttaccccggccaccacctaccagttccaatttgccggcatgaaaggagacatcgaggcggagaaatctgccaccgtacaggcaactaccctgcccgacagtggtcccgccctcaccggcccgaaggatcagtttaaaaaggaaggggagacggcggagtttgaagtggaggttcagggcatagatgagacaaaggacatcataacctacacatggcagcaatatgacgcagccggtatctaccagggtcaatggaacaatatagaaacgtggggagagcagaccaatgtgcttaagaggaccatccacgcggataaccgcagtgagttaaacggcaagcactaccgggtaaaggcagatatccaaaaaggaggcatacattccgccatcaccaccctatattcacgggcagccaccctgtatgtgatagagagcgacgacgaagccagggcggctgtagggctcaccgccgtctatgaagacggatctccacttctggaatataacggggaatactatataaatcctggagaaaaagtaatattaacagctacagcccttaagtcgggcggtcaaccggtagattctggagcgatagatattgggtatcaaatgaaccaggctttcgagcgtatatataaattggctgaggatgagggaccagatgagaatggacaggtaacagcctcccttcagacaggcccgggtacagacgcagatgaaggaatctgcagactggctgcagaatatagaactggtaatccggatgatcccagggcatactctgctccggttatcatccatataggggacgaggattttgtacaggaatcctaccagatcgaataccagctgaacggcggcgtaaatgccccggagaatccattggccatacctaagaatacccagggagccacccttgcggatgcgtccaaagactacgcttcctttaccggctggtatacagcccccgacacaggagcagacagccttattgcagatggaaggctgaccccggatttgctgcagacccaggcggaggagaacggcgctgtcaccttatacgccggatggcaggagaacgaatacccggtaacctacgatttaggggacagcgagcccgcagatacagccgcgccggcggtcaaccatccgaacaatccggacacctacaccatgaacgaaagcatactgctcagagacccgcagcggccgggttacacattcctcggctggtatacagacccggagcgtaccaaccgggtagactacctgcccccatacgacgcctccaacgggaatatttttacccctcctgagccagtcaccctgtatgcgaaatggcagcttgaggcatataccattacctacatcctggacggcggaagcaatgaccagaataatccggctttctacaccgtagagtcaccagacatcccgctgaaagccccgtcaaaggacggtgcggtatttacaggctggtacaggaacaccctccccgcagatgacacaaacgggaagcttgacaccataatcaggggaagtactggagacctgactctgtatgccaggtgggacgacgagaacaaaaaagaccccctggataaagacaaagacggttactggctgatccacaacctgggagaactgcagctcatgagagacatggtcaacagcggtggggactacgccacagaccactaccggctatgcgccaatataaacgggcagaacagcccctggagcataccggcagggacagaagagacgccatttaacggcacattcgaaggagacgactacatcatagacggactcatcctccagggaacaggaacctgtcaggggatattcggaaagattggtcccgaaggtctcgtaaataatctgaaaaccattgatctttacaccgacggaacctttacatacgcaggcggaatcgcggcagtaaacgaaggaaccatcgtcaaatgcaccagtggcctgaacgtaggaacagccccggtaatcaatggatacgagatagaagacatctccgagttcaataacaagattaccgccacagaagccgccggaggcatagtcggacaaaacgacggaaccatccgcgacagcagttccaacgcagccgtctcggccggggacacagcggccggaacccttggcaaggcaggcggcatcgccggtatcaaccacggctccattgccaacggatacaacaccggagaagtaacctccagcggccccgcaggcggtatcgccggacagaacaaaggcagcatattcaatcagtataattgcggcaaggtaaagagcagcgccgccgcaggcgcaggagctatcgcaggagccatggaggtcgacccgggagaaagtgagggaatggtcacagagtgctggtataacaattccgaattaccagcctgcccggatctggatctgggcggcagtgcacagtacaagaaaggctccgacatgaaaaaagacgcgttcgccgaagcattgacagctgcagcccaaagttcagatcccaagtacaacgcatggaatcagtccaacatcaaaaatggcggctatccccgtattgacagcaatatttaccaaaaagatacttccatggacgataccacggatatccaggtgcagacattaggagtacatccacactcccggcttaacgtcaggaaggttgacgaagaaagcggcaggtacaaggaaatgcaggaggaggcaaagagacagaacgcagaactcttaggcgtctataatatctcttatatgttcccggacggatatagttcagacacggaacaggacttaaggatacacttccccatgcaggccggatggaacagcaggaaactggcggtgctccacagagtcagcgaagggaattaccagattctggacggcacggagcaggggggaaattatatggctgcttcagaaggtctgtctacattcgcagtcctgcaatacaaggaggaaatcccgaatcccgacggcccggatatcggcggtaatccaggcgattccggttatctcccggtaaagaagaccacaggcagaacaaagaccggagatacggcgagtcctcttatctgggtatgcctcctgctggcggcaggagcagggatcacgatcggagtcaggagggagaagaaacatggacgcaggaaataaaaaagagccaggtcatagcagaacagatacggcccggaaaatcgtggtcgccgtgctggtagtcttatgcatcacccttctggcggcggtagtctatcttttgaaggaaaagaaaaccgccccggcagcggatcagattactgattgggatactggcatagaggaagatccgccacagggggcggacgccggtatcctgatccctggatacgacacggcagtgatggatgcaggaagcgaccgtttgcccatgagtatcggcaatcccaaagacaaccagtgtctgatgaaggtcaccctttgtcttgaggacggtacagaactatacgagtccagtctgcttgccccgggcgagggaatggaggaagttacactcaatcagagcatgaaagaaggaacctatgatatgaacgccaggttcgaatgcttttcaaaggacgataaacacacgcccctcaatgtggcggattccggttttgtgctcattgtgaaagagaaacagtagattcagactttgtgtcaaagaggaagggataaaatatggcggaaataaagaggaaaagtaaaaacagtaaaagcaggctacaaaagagtatgaaattgtggacaggaatcttaatggcgtgcgtgctgctgggggtcagcgtccttccgcttcacgcgcaggaacttgactcagagcagaaccaggagggagataccagtgtggagggaaccgttctggacgtatcacccggaactccaacctatgtgcttagaattcccagcgctatttcgtttaatcggctgaaggccccggcaacagacacagacagctttgaagacaccggcttccaggtgcagctggttagtatagacaatgtgtcaaagggaagtgtggtggcagttatgctaagggacgagacggcgccggcacaggcagataatccaaacgtgccgttcaccatcaaaaaagggaatattacgctgaactatgctgtatacaacaggtcttctgacccggatcagggaaccaacttagaggataacgcaacctggtatgaaaatggataccattttggaagcttcctccccaacgcccagccaggatcgtcacttccaggcgcattaagaataaatacgaggcagctgtacggcaagaatatggcggactatgcaggggattatcaaggcaaactccatttttactctaagatagccaatgcggcagattataattagtggtcagaggcatgaagcagaacattcgaaagcattctcacttggcagcgttactagccgcatgtttcctttcactttccttccaacttgcggccagcgccggggaagaaaagtccgtcgcagggcaggaacagtctgcaactatgcaggagcagtccaccatcgtgacggcaaccgtagaatcccctaacgaagatgacaaggagcagccgggcgaaacggtggcaaagacaggggacaaagcagaaatgctgttatggatatgcctcatcgcggcgaccagcgcaatagcgctcaagataaaaaagataagacattattccagaatgatagaatagttaaaaaaacgtggctggtgctttggttattttggcaccagccatgcacattataaaggacaccggtcagactgccgccggataagcatttctatattaagattaagcgattgaaagaaatataaagtggatgaggaggcgagaatatgatatagttaacctgatggcagcaagaagaagttagagatttgccccgtacataaggctgtcatgttgatgtgttaacagccaggacgtaatacgaaaggagtttagacatggcaatttcaaatataaaggtatcactcccatgtgatattcaaaaggtatgggaagcagtgacatctcttgaagattgtgcctggcgcagcgacctgggcaaaattgaaatcgtaaatgagaatcagtttatagagtatacgaaagatgggtatgcgacgacatttacaattacagaaaaagaaccttgtaaacgatatgagtttgatatggaaaatggaaatatgcaaggccattggactggaatatttactaagaagggaaatagtacggaattagattttacggaggatgttactgccaaaaagttacttatgaagccttttgtaaggggatatctgaaaaagcagcagcagttatatgtatcagatctaaagaagttcttggagaggtgaactttaatgggaaatcaagataaaaagaaggttcagaaatatatggcgatatatatgagcatagggatgtgctttggagtttcaggcggattaatattcggaatgattttatctccggataacaggactcttgggatgtgctttgggataccaattgggatgtgtattggcatggcaataggttctgcaaaggataaacggctttcagaaaatatgatgaaaataagcagagtagaaatgatacaagaatcatctgacatgttggtttatgctatggataaaaacggagtagagaaaaaatataaggttcccgagaaaaagatgaaagaagaaaaattttcagtcggaaatcgcgttgctgaagaaacagggggttctttggtgtctttggaaagcgaatagtcgaaacataagcacgaaaagaaaatcttgaatttataaggagtattgctatgggattttggttttttatgttgatcatggatctgcttattccatttacaatgataggctttggcaaatgctttttgaaaaaggcgccggataatatcaattctgtattcggctataggacatctatgtctatgaaaaataaggatacatggatttttgcccataaatactgcggtaaaatgtggtatatctgtggactgattttattgccgatatcatttatcgttatgatagcagtcataggcaaggagaaagatatcgttggaaatgttgggggaattctctgcggcatccagatgataccattaatcggttccattattcctacggaaatagcacttagaaaagttttcgaccaatatgggaatagaagacattgaatcatacgatttcggtctgtcgagataaagaactatgaatttggggatgagaaacatgaataaacaacagagagcggatttgttactggtgatggtcacggcattttgggggctgtcttattatttgactgacttgtgtctgactgatttgccacctatgtgtctgaatgcgtttcgatttatttcggctttttttgtgcttggcattatatttcataaaaaccttttttgcttaaattttattacgattcgttatagttttttagtgggaatagcgctatcgggaacctatgtattctatggatatggaatatcccgtacttcgctttctaacgctggctttatctgtgccttaccggtagtatttactccagtctttgcctttctgataaatcgtacacgtcccagccgcaaactaatagcgtgtctgttcctgtgctccctgggattagcgctactaacgctgaacgatagccttcgtccggcattaggcgatatcatctgtcttggcgtgccaatctgctatgcttttgacctgcttttaacggaaaaagccgtgcagcattccgaggttgacgcgctggggcttggcgtatgtcagttaggcgtagttgggatcattacgctggcattgtcaatgcttttggagcatccgcatttgccaaccacgccaatgacatggggcgcggcattattcttgggcatattgtgtagcggcgtggcatttattattcagtcggtacagcagcaatatacgacagccagccacgttggcctgattttcactctggagccagtatttgctgctattgtggcttatttttttgctggcgaggtacttacttcccgcagttatgtgggaatggcattcatgcttttaagcctcgtggttatggaagtggattttcctataaagaggcaggaggtgactatggaatagcaatgtagcttcataatcagttatgttgttttagtagcgaatgttaaggaaactgcatagaatagatcatggatgcttgaggatgaatcaatctcaaaatagggaggattcttatatgacagccagcaaagacattttggcagatagatattcggctaaatcgtctattcatgaaaatgcaatcattaaaaaaatatctttggtcagcattatcggaaatattatactttctggatttaaattgtttgccgggatttgtggccgctcgggggcaatgatttccgattccattcattctatgtcagatgtaattaccacatttattgcttttttaggagttaaaatatcaaaaaaacctgcggataaagagcatccttatggacatgaccggctggagtgcgttgccgcgctgcttctgggatccattcttctagttaccggtattggcattggaaaagcagggctgcaaaatattatcgctggaaattatgatactcttgtagttcccggcatgattgcgctagttgcggcaattgtgtctattgttgggaaagaggctatgtactggtacacaaggtattatgccaagatcattgattctgcggcatttatggcggatgcatggcatcatagatcggacgctttttcttccgttggctctctgattggcatcagcggcgcaatgcttggctttccggtgctggattcggtagcaagcgttgtaatctgcttatttatattgaaagtctcgtgtgatatattgcgggatgctataaggaagatgctggacactgcctgtgatgcggactatgaaaaaaaactgacggattacatcagttcgcaggaagaggtaattcgcgttgatttgcttcaatccagaatgtttgggaataaggtgtatatcgacctggaaattgcgatagaaggcgataagtcccttcgcgctgcccatcgcattgccgagcagattcatgataaggtagagaagacctttcccgagatcaagcacattatgatacatgtaaatccggctggaagctgattgccttgcgatctcatcacaggaataaaatataagcagaagatatacgcccctgcctctcacgcatgagaagcaggggcattttgagcattctggcttgtgaattagaatcaggcttctggatccagacatccttccagctggcaggaaacattctgcagtttcgcctggagaacgatttccagcctggagacggctccaatcatgctagttacggaacggttgagttcaaacaactcatcatttgtcacatcttccatattgatgaatgcctgcattttctgaccttccgcatttaagatgcgggcaagcgcagcttcttgaagagccaccgagtcgatcaggtcaataagagcctggcatctgggcgtgagaatattcgtggttatggtcgacgtattattatctgggttgggatccggcgtcgtggatgtcaccgatgctgtattcgtaatagttccctgtgcctgcggactgatggtaccccggatgataattgtccgggatgctccggccgctatggttccgagattcaggcttcccgtccatgggctgaaagtagttccgttgtctgtagaatattgcgcatccgtaatactggatgggagattgtctgtgagtatgacattttcagaagaagaaggacctgcatttgctactgtaagggtataggtcagttctcttcctggcagcgttgcagcgcttgcggtttttgtcaccgagatatctgcggatgtgcctgtaatcagcacagggacctcgttggactccacctggaagactgcgggaattccgccttcgaccggcgtataagagtaagtgatggacgcccggttaagggttgggttctgggcagggatggaggtggctgtggctgaaaatgtgactgtaacactctggccgccagggatatccggcagtgaaaatcctgtattcgggttagcggatgggaaggtggccccattgacccttacgctgcctggaacaaaggttacgcctaccggaaggagatctctaaagaatacttcggtcagtggattggcgcaggtatcagtcaaggttacggtataatcgaagacttctccgacgctgacagaagacgcgctggctgtttttacaggcgtgaattggcgtatctgtatctcctggaatgcaacatcgtcgattgcgtaatcatttccgattacttcaggcccttcgctcagaaattccacggtgaggctggtgttgtcctgggaattgatgacgcttccgatctgtttccattccggcgcattcacatttggaggtatgagtatgcctaatggggcactgtacaggacgttatcgtcttcatccagaattcggacgctaagttcaggattcggatagcctgttactttgaagaggttcatgatccatgcggtaaatagatagttcgtgttaggctgtacggccacggtatccctgaaaaatacagagcctggattgaagccatttacaatcatcatccgccctgtctcgttgccctgcgtatgatccgcaatcctccaccatgcgccgatttctgaactcatggagttattcatgatgttttgtaccgtatactcgccgcccaggggcgcgaatacatcaggattgggcagtacatacgtgaagtcaggcgttacgccgggatagggctcggtaggcgctcccgtattggccggggttccctggggaaaactgccgaaggttccgttatcagccgcgttgatcaagttttcgccggatataattgcgcactggtcaatcaaagcttccaatggcgtatagataacaggaccatttaggaagtcctgatttgtaatattactgccttccacggttacaaaaagcgtatccggcgttacggagtccagattggtggaacctgcaggtggattgcttacagcggtaataggcgggttgacgccctgcggtatgctgccgcttgccgcattgttaaagtctcccggcgttggcaggccgccggctgcgccaaaggattcaacgattctatagtttccatctggcacattgataaaagaataatttccgttgctgtcggtaagcacggtaagccttgcattggttgcaatattctgtaaaacaaccgggatattggcaatgccggagtctccggaggagatggatgcgcttcggttccggtcaaaaatgactctacctgatatggttgccatgagagatacctccattcatttcttgatttggactgctgtctgatgcggcgggacactggacaaagatttcggcttttccctggagtatcagttcaagccttgtgactgcccctatcattaattcggctgatttgttcattcttaataattcatcggtggatgtgccatctgccaagagaattgcttccattttttccccttccgcatttaggatatgcgaaagagaactttcctgcattgctacggattctaatagatctgttattgcctggtccgcagttttatcgccaggcgttataataggcatgcccataagattacctcctgaattcaattttaaaatattactctacttatatatatgcatatattttgcagtagttaattccctggaaagtgtatccgcagtagacgaagcgcatatagtaaatacgagtaaactgtacgtaatttcatagggagggcacgatgaatcaatcactggaaccggagtcttctacaatcttatccgggcatctttgcaaatgctatgagggaatcgcgtttgactgcaggtttttctacctgactttgccttcggaaaataaaatatttaaattcagccgggaatttatctttataaaatattatgaagtgcgcaggccttatgccgctattacttttgacagcattgaaaattgtttttgggcgtcggatgaaaggacgcgcgatatcatctttaaacttgacggtgatttcagagaaatggggcagatcaaaatatcacattgccgcgcggaggattcctacatctgctctttgagccataactgtgaaaatgacacgattctcgtcgcatatgaaaactgtattttagaggttccaaaagaaggaaacccaatccgtattctacagcagtctgattgcagcatttatctgggggttctttcgataccgccataccatgtggtgatccagtcatgcaggcgtaagcagtccatagatattttccttgaagatcaattgataaaaaactgctgtatctttgattcttcggagcatcagctcaaagacctggcattcgttcccttctgtgatgatgagagacagaccattgtgcttgtgattctggcagaggattcctgcaaacgtccctgcctgctgaaatgcgtcctggattcctgcggcatgaaacttagcgattgtaactttatctgctgctgcaggcaaggaggctgttcctgcgatgtgatagagtcgattgccagagcggaatgtgccttggcacacatcctgaacgcagagggagaaaaattacagaaggcagtggaaattgcagataacatatgtgaactgcttgagattaatcaatctgtcaataagacaattactaaaataacatttttagagcaagtgctttatgcgaaactagaggctgtcagtgacggtaaggcctgtgatatctgtaaggggcagaagaagtaatagaaaaagttccgaggatggtggttcatcatctcccggaactttttaaaggtattttattactttttaaaatagtccgatataggaaccgggccttccaagatttctctttccacagacaggtaccggtctcttcccgaacgcacggaccattttattaaggttatatgattattttctatttcaatgccagtaatacaccggggatgcacgcagcttcccgtattaaaataagttccttcccgcggctgcgaaaatacgggcctgtgcgtgtggccggcaatcagaatggggtagtgctcccgtgtgtaagacgatagtttcttttccacgcgttcttttgccttcctggggcgccctgcgcctgtgggatctaaaaagccgactaattccagatgccgccatacatatcttaccaggaatcttgcaagcggccacaacgtgtcatttaggagatcgccctgatgtccatgaaccaggaacaactcttcatttccgcaagtgctctttagaatcaggccttctgtggcggtttccgttaagagaactttttcacagcgggatgattcgcagtaataggtgccgcagtggcgttccatatagccttttcttcgctttacgatgtcgtgattgccatacagcagatggagcctgcctgccttgttaaattcagacagcatccaaaagatgtcgctgtgtacctctacaatggtttttaacttcctgttttcccacaattcatctccatcgcccagttcaatataggtaaaaccattctggtaataatattgcagggctccgaaacagactgtctgatttgccaggaaattatcccctgcatttccctggccacggtggcagtcactcataagaatcagtttcgaatcggaatcaaaggggatttcctgggcgtgccggtatatttcatccagtcttttaggtgttgagacagccttcatgggaactacctccttgcgctatcatagcagtcatcttccggcagatattcggtatcctggtcatagccgcaatcacaagagccataatgacagttacagctgttgtggctgccgtagcgatactcacagttccgctcatggctgcagcgctgcccgtaaggatcacatgggggcttaggcgggcacggcggacatgggtgcacaggcgggtgagggggcttaggcgggcacgggtgcacaggtggcagaggcggctctggcggcagcggatcaggagccgggtgaggcgggcgaccctccagccattccttaatccattcaaatgcgtcgtaaacgcctcgtgcgtaaagcgagtcaatgaataattgatagagttccggaaccatagcctttatatactccagtttgtcgagggtctggctgtatttggcggtggtgaattcatataatttgcaattattactgtttgtctgctgtactatggcttcggcagcctcattgcgtgacaggggctgtggggaatgaggggcagcatagtgaatagatacggtctttcttccagaggaatattcctttttggtgtatccgatttcgatcaatgccttttggaaggcatctttcatcccatgatccgggaatgtgatcttggcatccatagtcagcatatccgtatcggaaaattgtcctagtttaaatcctgttagccaccaatgcatggcactgcgcttcagtatgacttttccatttcgacgcagcacaaaggagaggttaagcatctcttcatttccgatattttcataaaaagttcctttaaattcgtcggtatccacatcttcgcgagttgtattatatactccgatttctcctccggtcgtgattccatactggcctttccacagttcgataagccagcgctttcccctataggagaagggaatgggttcgcagtccataatcatattaaacagcggcgcggcgtcatcatagagacgacagtatcctacttgtctctgccagcagttcataagggaataaaaataatcgccttttatttcgtaagcaaaaccagtttctttgagatcggcatttaattctctttgctggcgtaatttatcaggatccggatggaatcgatggctccgaacccgccagattatgagaactacaatgacagcagcaagaatagccgccccaattattattaatattgtgggcatgatatgtgtcctttcttttcatgttaatatattctattcttcgtcatttttttggtgaaaacgactggtatagactatgaaaatggacattaaaaagcacgctatttataacggcagttctttcgtgtaccgaatcatagaaaccgtggcaaacagcgcgacaatcgactctgttattggcatggtaagccaaaggcagctgtcctttatcaatgggagaataaatattaaaataccgcttactacaagccctcttgctacagaaacaatgaatgaggccttaggctttagcagcgcctgaaaataatatgtagagaaaatattaaacggcaggagcaaaaaagagagtccatagcagctgatgatggccggagccattgtcaatatttctctggtcggcgtcataaagatcctcacaaacacatttggcacgagcaatgagagcgaggtccataagaggctgaagaacgctaccgtatatagagcatattttaatgtctgctttattctctggcctgaccctgcgccatagttgacggagataatcggctgcgaggcctgcccgacgctgtaggcgcagcattggacgaatgtgctgatattcacgataatcccgtagatagaaagggcgcttgtgccgaaatatttcataatctgacgattgaataaaatcgttaaaattcccatcgcgatatcaataaaaaaggttgaaaatcctgttaccagtatttctttcaatttataaaatatcctggccggttttacaaaagccagtgaatttttagaggaaaagaagtgggacagcattacgatgcaagagatgaccgaaccgatagccgtcgctaatcccgcccccaaaattcccatatcaaacataaagacgaagatataatcgccaaacacgttgaatatgccgccggacaagacgccagcggttgcaagcgccggatttttgtcattccttaaaaaggcagccagcatttgaacgaataaaaagcatggaacgacaaattttatagggatcagataggtttgggctaattctaacaggtgttctttggcgccaaagaacagcaataattctttgtcaaaaaatagtatggcgatccatgcaaggatagataaaaagactgagccaattactgccgcggtgaaatactcgttttcgtttttggaaagcctgtcagttcttccttttgagatactgtagatgacggagccgccgattcccataagcaatccaagactgtatataatattccagataggggcaacaactgccagcgcggcagtgccgtcagggccttgatattgtcctacgacagccatatctacgatagagtagatggaagtgatcagggcgcttccaaaagcggcagagaagtatttaaggtaaataggtcttacttttccatttaagaaatccatacatttccctcctttttccaataaaaaaactgggcaaggaacagatatttcaatctgccgccttgtccagcttatcatttctaaaatgaatgactcgccctccgagcaatgcttattatagcaaaatcaattttattgtcaagcgcttccttgaaattcttaatcgaactagccttcttcaaggaaacttttgattgtctgaaataactgctgatagtctaccggcttggccaaatggccattcattccagattcataggccttcacaacatcttcatggaacgcattggctgtcatggcaataataggaatggtctttgccctggcatgccctgacctgcggatggactcggtggactggtagccgttcataactggcatctgcacatccataaggattagatctagttcgtcggcatcagacataaatatgtctacagcctcctgcccgttgcaagcgcaggtaacgtcgatattcatcaatttcaacatctccatggcgatctcgcggtttagctcattatcctcaaccagcagcacgcggcagtccgccatctgcatattctcatactcttgtccctgggaatatactcttttttctgtaccggtaacggaaagcagcgtattatagagagtggaagagaagataggctttgacagaaatgcattggctcctgcctcgcgcgcgctcttttcaatggaactccagtcataagccgtaatgatgatgatcgtggtatcaggccctacaaactctcttaccttccgtgtcacctctatgccgttcatatcaggcatcttccagtcaataaagcatacatcatagtcttccccgattttatgtgcagagatgaccttttctacacattccgtaccacttagaacccagctggatgagatgcccagattctccaatgtcagagacgtatgcagacagctgtcacggtcgtcgtctgcaataaggacattcaaagcatcaagatcctggggacgatgatgaatttgcttttcattcaccggcgtatcaaaatctaattcaacggtaaaggtgcttccttgatttggctcgctctcaaccgcgatcgtgccgcccatcaaagtaatcagattcttggtaatagacattcccaatccggtacctttactttcctgattgttacatcggttttcctgctcaaaaggctggaacagccgctccataaattccggagtcatgccgatgcctgtatccttaactgtaaaacgtaggcgcacccggtttttctttctctgaagctgacgaatctccaagaccactttgccgccttccggcgtgaatttcagcgcgttggacagaagattgatcaagatctggttgagacggagggaatcccctaacagatctgtatcagtaatatctaccaaaggcatactgaaatctatattcttgtccgcagcctgctgatatatgatggacgtaatatactccgcaacatgttccagattaaaggtctccttggaaacagtcatcttgccttcatcaatctttgacatgtcaagaacatcattgatcaaggtcataaggtgcttggatgaatagccgattttttccagacagctttctacgcgcgtccgatcttctatgaaagcggcggcaatcgtcgtcatgccaatgattgcattcataggagtacggatttcatgactcattttggaaaggaaattctgcttggcagaatttgcgttttgcgcattgataagcgcatcctccaaagtctgcttgatgcgcatatcttctgactggtcagacacagacagtatgcagcggacaatcttgccatggacgatatatggaaacatctggaggcgtatccaacggatctctccggaagaaacgcgcatatgcagatcaatgcttttgtcgccgtcaagtcctctttgctgtagaaattcatcaaatgccttccgatcttctctggcaatccgatcgcgaagagccgtcaagtccttggtaaattcagtttcttttatttccagtacccgctcgcagtttgaactcacatattccagggaatcatgttcttgattaagaatcagaaataccatatctacgcttgtggaaaggttgtcaaacagctgctcccggtatcggacttcctggatgttcttctgttctctccagaaggccagcaggaaataggagggaaggaagagtgtaagcagcacggaggctgcggtagcctttgtagccatgcctcttgaatctttttccagattctgtactttcttatcagcataatcgatgattgtctccagcgcgtcgtttaccgcatcgtatttaggatacaagtttgcttcaacatatttgattgtctcctgttcatctagatttaccacaatgggcagcgcctcattctgcgttttctccagcgcctccattgccttctgaagccggtcggcatcctcttttggccccaggtactggcggctaattatgccgattgaatgatactgcatctcatatctttcattcaataattgctgtaaatcctgttcgctccagtccggccgggtaaacatactcataatgaagaagcgcatatccaaaagacgggagcgggtagcccttgattcatttgagacagtatatggatgttcatagatgatggatgccattttctgcatccggtaggtagtaataatacttgaagcagacacaataatggccagtatgcataccgcgatcagccctttgccaggaatgccaaatcgcttcttctctgttttcatccgttacttctccttctttcccagtttaaaactgctggccagcctgcttaataactgcgcctgataggatagctcttcactagtggcagcgatttcttctgccgtagcagaactagactgtacaatatcggaaatttgattgatttcctgcatgatctggcggacagataattcctgtttcaccgaagcatcggttatgtaatgaatggattcgcttatgctttccacttcatttgccactcttaatagcgaattggcagtgaggtctgcaattttgtctccctgagtgactttatcaagcgatttttttatcaagtctgccgtactctttgatgcttctgatgatttggtcgccagctgccggatctcattggccacaacggaaaatccttttccatgttcccctgcccgtgccgcctccacgcccgcattcaaagcgaggatattggtctggaaagcgatatcattaatggtgttgatgatttgtccgattaaatttgaactgctacggatttctgccatggctgacagcatgtcctgcatctgcctgcggctgccttccgcatccgcccgcactgccttggactgctcatttactgccttggcattctttacgttatttgccacctgttccgagatgtcattgatggcagtcgacagcgcttctatggaggcggcctgttccgtagctccctgggcctggatctgagcgcctgaagctacctgctctgatccggcggccacttgctgcgcagattggctgatctgcagcaaggcggctctcagattaccgataatcatatccaaggaggagagtacgctgtccaattccccgacgtaactgtcctttgcctggctgcttatgccaaagttgccattggccatctcattcagcaagtatgtctcgtccctgatgaccgttgaaagtatggtgatcatgctcctcatatcattggcaagatgccccatctcgtctccggactcataggtaacctctgtagttgaaaactgaccgctggcgatgccgagcgcggcctgctcaagttccttgattcccttggaaatccccctggagatagacatgcagaagccaatgctaataatcaggctggcaatgcctaaggctaccagcatcgtaatggcattcgcctgctggctttttagttcctccatcagctgcagccctttgctgttcccgctttcaatcagtttgtccaggtttttctgggcctcttttattaccaatatgttattgtgttccatataatctgcagcttcttcatttttattctcgctcgccagagaaaggacgtgttcccgcataggggtgagccgggtcaggcaatcttcgagattctctataatttgctgatcgcccaaaaagtgtttcttgacgacaggaagttcatcctgaattgttgcagcagaatccagcgcattggcttttgcttccttaataatatcctcatctgtatttacaatggtacggtaggtggctttctgcattctttcaaaatttgaattaatgatgttggcactctcattgacgacgaatggtccttcataaaaaaccttcatcttagaattcagattcactagatttacgatacctacgccaaaaccaatacacatcaacgccagaattacggaatatgaaaccaataattttctgcctatactgaacgttttcatccttaacctccattatgctctttgttatttccatcctgtattcgaactctgctcacgttatgaatatagtctatcatagtccatgaacataagcaattcatttgtccttataaaattgatatgggttgaaaacaatggcagacatgtgccgcttatgctagaatagaatcaggaggtgtatgaatggaatcgaataatcaattatatcagattgtttacgattattatgctaccagaattctttttggatactataaattgggggagtcccttccgacaatatcaaagatcagcgaatctttccagctgtccgtgccaaccgtcaggacggcgctggcgcttctggaaaaggacagatatatcataactaaggctccaaaggcagccaaggtaatctataaagtttctcaggatgattattttcagtatgcttctgagtacctgctggcgcgtaaagatggacttgcagatattggacgcgtgaatctgtggctgtttggccctttattagacgccggtatcagacaatggaatgaagatgattggaacatgtgctggcaggagatcaaaaactatgattctgatgagatgtctcttgccatgcgcatatatatgacagctctgtcttctctgaaaaatgatttgattctcaattttttctgggaagtaaaccgttatacgcgtttcccctatctatgcagcgagcgtgagattctgaaggaaataggcagagatgacgtgatggataagctgattgaaaaaatagatacgctttccaaaactcaaatcgcagaatacctcacccatgaattgggcctggtgtataaaaatgagaatgattatctgcttgagaaaattcagacaataaaaccagatgcttctttggagagggtgatgcagattccgtttgagtggaagttctatcataagcgttctcagattcgttattccatcggggcacagatcatattagagattctaaatgggcgctatcctgtgggaagctatcttccatccctgcctaagatggcaaaactttaccaggtatctgtaattaccatacgccgtaccctaatctttttggctgattttggcgtggtgcggtcttatcagggaaagggtacgcaggtctgtctggggcagggagaggtggatctgtctcatgataacgtacatattgccctgaaatactttttagagagccttcaatttcttgcccttacaatccggtccgtctgccgattcacttttggagagatctctgatgaggcatttcgtgaattgatgcagacgctgaaccggattcatgaacaggagatggattataagattcttgatatttttctgacttttattatagaacattgcccatcggctataattagccattgctaccataaactggcgaaatgcctgacggtaggatatccattttatcttcagcaatggaaggcagaagattacaagcagatgtttatcgatatgattctgcgagtgactaagagtttagaatgcagggacatagagggcttgattgagcaatggggaacgtttttggaagagcaggtgcagtatagccggacatttgttgaacagacaaaaggctagagttcaaggaagacatatccattattagagcaggaggttttaacatgaaagtattgatgattaacggaagtcctcacagcaatggaaatacatttacagccttgcaggagatggaaaagatatttaaggaagagggaatcgcaaccgaaataattcatgcgggcaatcaggatataagaggctgcattgcctgctattcctgtaaggataaggggcggtgcatatttgatgatatcgtaaatgaagtggcgccgaagtttgaagcgtgtgatggactggtcgtggcaagcccggtctattatgcatccgccaatgccacgctgatcgctcttcttgaccgcctgttttacagtacccgttttgacaagacgatgaaggtcggggccagcgtcgtagcagcgagaagaggagggctgtcagccacgtttgacgaactgaataaatattttaccattgcgggaatgccggttgcatccagccagtactggaacagcatccacgggagcgcgcccgcagaagcaaggcaggataaggaagggcttcaaatcatgcgtacgctggcaagaaacatggcatttctcataaaaagcattcaattaggaaaagagacttacgggctgccggaaaaagagccagccacgcctatgaattttataagataaagattagaggaagcagcaaacaaggcaggagagtcagatcgactctcctgccttgttttggagtcttgaattcgaatagattaagaggcggttcatcttgacagttgtaggaaaggatgttactataaaataacagaccgacggtcggtctatatttaagatgaggagattattatgagaatcgtaaaagaagcaaacgaaagaaaaaatgaaatattagatgccgcggcagcattgttcgcacaaaaaggattcgatcataccagtaccagtgaaattatggaggcagttgggattgcaaaaggcacgctttatcatcattttaagtcgaaagagtctatcatggatgcgattatcgagagacagagcgagcgtatgcttgctgcggccaggaagacggccgaagatcgcagcatccctgtgccggaacgcatgctccgcgtagtgatggcgctgaagctggaaggcgcgcaaggggaaggaggcagggatatgattgagcatctgcataagccccagaatgcgctgatgcatcagaaatcgaaacagattattatgaaggaggttccgccaattttggcgatcgtcctgcaagatggcatagaacaagggctttttgattcgccctatcctctggaatgcatggagatgtccgtagcctatctgaatacgctgctggatgacggaatcatagaacttacggaagaagagcgccgtggacggatccaggccttcatcttccatttggaacggcttttgggagtggagcaaggtcagtttggctttatcgaaaagatgtttgaaggtggtgagtaggatggatgagacggaaaagtcttttcataaatttttacttctttgggccggaaattttgtttcctctgtgggaagcggactgacttccttcgggctgggcgtgtatatctttaagcagaccggaagggcgtccctgatggcgctggtgactctgcttgctttcttgccttccttactgttgagcgtacccgccggggtactggcagaccgctatgaccgcagaatcctgatggttctgggagacagcctgtctgccttgggattgttgtatatcctgctatgcttaatgcagggagaggcacaaatctggcagatctgcgtaggagttacagtaagttctgtatttgcgtcgcttctggagccagcatacaaatctacgattacggatctcctgacggcggaacagttcagcaaggcaagcgggctggtgcaattggccggctccgcaaagtatctgctatcccctgttctggcaggattccttctggggattgcagacatacgccttttgcttatcattgatatctgtacatttttcgtgaccgtctctaccacccttgttgttcgaaaagggctgacaggcagaagcgttcctgtttctagttctatggctagcgaattacgggaaggatttagaggtcttacggagaagaaaggcgtttttttactggcggcaatggggtcggcgattacattctgcctgggagtagtccagaccctggcttctcctatggtgcttagtttttccaatagtaccgtactaggaacgatgatgacggtggtagcgttagggatgctggtatccagtttcattttgggaagcattaccataaaaaagggatattcaagactccttgcctcttccctttttggcgccggagtcttcatggcactattcgggcttcgggaagatattatttttatcagtgtatctggattcctcttttttgccatgctgccgtttgccaataccagtatcgactatctgattcgtaccaatgtaggcaaccagattcagggacgtgtctggggaatcatcggactgatttcccagcttgggtatgtggcagcctatgcggtctccggaatattggccgactatgtgtttacccctttgctgctcccggaaggagtcctcgcgggcagcgtagggaaaatcctgggtacaggtgatggaagggggattggctttctcatcgtccttgcggggctgctgctctgcgcaaccgctgttatgctctcgggtatgaaatctatccgcgggctggaaaaaagaggtgtctatgaaccgtaaattaatttggaaagatatcgttagaaataaagtagtgtctattgctattatgctgtttatcgctgcagcatctatgctgctgtccttaagcggcatccttgcgacccatcttttgggctccattgaccagttgatgcaaaaggctaagacgccgcattttatgcagatgcattccggcgaggcaaatctagagcaggtggagcgctttgcgaaagaggacggccgggtggagaagtatcaggccttggaattcttgaatatggcaagtgaaaaaatcatcattggagggaaatcccttgctggaaatgtccaggacaatggattttgcacgcagagcggggaatttgattatctattggatatggacgatcagccagttcgccctaaagacggagaactctatgtcccggtctgctattataaggatcagactgctaagattggagatcgggcagtgatagccgggaaggattttgaggtggcgggatttatcagggattcacagatgaattcttccctcgcttcttccaaacgttttctggtgagcgggcatgactatgcacggttgaaaactttcggcaccgtggaatatctgattgaattccggctaaaagatctatcggaacttggagaattcgagaccgcctatgaggacgccggtcttccctccaatggggcggctcttacctggccgctgtttcgaatgatcagtgcagtctcggatggaattatgattgccctgatttggctggccagcatgcttgtaattttgattgccctgctgtgcattcgatttaccttgcttgcaaaaatcgaagatgactatcgggagatcggagtcatgaaggcgatcggaatgagggtgtctgacatccaaggcatttatctttccatctatgccgctgtggcggggggcggatgcttgcttggatttttgctgtctcttctgtttcgcaagccgcttcaggagggaatccgcctgaactttgggaacggagggagcggcgttatggctttgcttctggggcttggtggagacctgcttttactatgcatgattcttttgtatctgcgaagaatcctaaagcgatttcgtaagttatcagcggcgcaggcgataagatcgggcagcgcttgggagaaggggaacaatcctgggatctttcgactgtcaggaaacagatgccttagtacgaatctttttctgggattgagagatataataaccagaaaacgcatgtatcttacgatgctggtgacggctgtgctggccatgtttctcatgattgtaccgcaaaacctttcccatacgatttcagatagcgggttcgtatcttatctgggaatcgggcattgcgatttgagaatggacatacagcagacagaagggattgggaaaaaagcggaagaaattgatcgttatatggcaaaggatccggacattaaaaaatatgctgtctttaccaccaggtcttatcggatgaggcttgaggacgatacacaagagaatataaaggtagaaaccggtcgccatgatgttttccctgtccagtatacccaagggagcctgccgatttctaaacaggacattgccttgtctgcgttgtatgccaaagaactggaaaagcaggtgggagatcggattacgcttttgacgggaaccggggagaaggaactggtggtatgcggcatctattctgatatcacgaatggggggaaaactgcgaaagcggtctttccaagtgatgacggggaggcgatcttttgtaccgtctgcgcagaggtaggaaagactggccaactgccggataagattgcccagtatgaaaagtattttccctttgccaaagtgacggacatcgagacgtatattggccagacatttggccagaccctgcgttcagtaaggacggcggcgctggcggcagcggtggtggcagcggcggttacgcttctgatcacgctgctgtttatgaaacttctgaccgcaaaagacagatattccattgccattatgaaatctacaggtttttccaattccgatattacgaaacagtatgtctggagagcagttcttgtgacgattgcaggcattttcctgggtacgatgctggcaggaacggtgggggaacagctggcaggagcggcgatggcatctttgggggcatcggccttccaatttcaggtaaatccgctatcagcctatctattgtcacctgcgatcttgcttttgacagcagtgatcgcagcgatagccagtacaaataacgcgggaaaggtacacatttcccaatcaataaaggagtaaaaatgaaaaacttattatgtggaaaagaaatcgtaaaatcgtttggagagggcaatgagaagaccagagtcttgaaccaggtgtccctggaggttgagaggggagaatacctgtcggtcatggggccgtccggctctggaaaatccacgcttttgtatgcgcttagcggcatggacatcatagacagcggcagcgtgtccctggacggattagaactgtcggggcttgaggatgaggaactgtccgatcttcgcaggaggaagatgggattcgtgtttcagcagcctgcgcttcttaggaatcttaatatcctggataatatcatccttcctatgatgcgggacaacaggaaacaggtgggaacgcttgtccagaaggccaaaacgctgatgaggctgtccggcatcgagggtctggaagaaagggagattacccagatgtcaggagggcagctccagcgcgcgggcatatgccgggcactcatggcggatccagatattatcttcggggatgagcctaccggagccttgaattccaaggcggcccaggagatcctggatctttttgaccagatacagaaggcagggacagcgatccttctggtaactcatgatgtacaggtggcagccaggacgaaccgcgtgctttttatgcaggatggaaggattgtcagcgaacttaggtttcaaaaagagaagctggattataaggcacgtgcagagcaaatcatggtgcagatgcgaagagttggaatataaaaatagcactttttattaagacaaatttgtttgcaaactgctataatagatgagatggaagaggagggataccatgaacgtgtataaaaaaattgtgaaaaaggttattgactatatagaagacaatttagaaaacgaaattgatttagataagatagcggaaaatattggctattccaaatttcatctaaatcggatttttacagaagaaacaggctacacgatttacaagtatctgcaaatgcgcagacttacgattgccgcccaaaagctggtcgatacggagaaaccgattacccagattgcttatgaagcagggtacaattcgcaacaggcattttcactggcatttaagcagatttatctatatcctcctaaaacatacagagatataggtgtttttgttcccaagcaaaacaaaatctccatgaaatgccgtgcttattctggctatggaaaatataaagtttatgtaagaaaaattggggggatggcagcatgagtacagttccttatgtgattgagcagacaagtcgcggagaacgcagttatgatattttttcaagacttttatccgatcggatcatttttttaggagaagaggtgagtgatacctcagcaagtttgattgtagcgcaattactttttctggaagcgcaggatcctggcaaagatattcaattgtatatcaatagtccgggcggatctgtaactgccggatttgcaatctatgatacgatgcagtatatcaaatgtaatgtatcaaccatatgcgttggacttgcggcgagcttcggagcattcttattagcgggcggtgcaaagggaaaaagaatggcattgccaaacgctgaaattatgatccatcagccggctatgcacggcaatggtattcaagggcccgccagtgacatcaaaattatgtcagactatatgcaaaacagtaagaaacggttaaatcgcatcttagcagaaaatacaggccatacggtggaagagattgaacgggatacagatcgggatcattttatgagtgctgatgaagccctaaaatatggcctgattgatacgattatatcaaatagatagaatatggaacgccataagagtgcgttccttttttattttcagatatattgattgacaacttgatatcccgatatctattattgtaagagaggctttataaatacctagaggaggtctgattatggacaaaactttctgcgaagttaaattatttcaggtaaagcctgataagctggatgaatttgaaaaattgattgctgttgttgctaaagagcaaaaacagcaaaagggttgtattgatattaaatatttaaaaaggttttatgtatttgatgacatcaaagagcagccaagagaactcaccagaatcgttaaatgtgtaaaatattattcttactgggactttgacactttggaaaattattcaaatgcaactcattggctttttgaaaaatattcgaaggaaatatttaagctgctgattatgccttttgacataaattgcggatattcaattagctgaactgaaaatataaggagataataatgataaagttaagccaggaagcagaaaaaataatgcttgagcgttttggaagagattctattgttgctttggcaacagtagaaaatgaaattccatatgtgcgaaatgtaaatgcttattatgagaatggttcattctatattattacatatgcactttcaaataagatgaagcatatagaaaacaacccaactgttgcaatagcgagtgattggtttaccgcacatggtaaaggcatcaatttaggatattttggcaaaacagaaaatcttgagattgctgaaaaaatgaaaaatgcctttagcgaatggattgacaatgggcacaataattttgatgatgagaacacaataattctatgtatagaattaacggatggcttgttactttcgcatggcacaaggtatgagttttaattaagaattaatggtacagatgtgaatggagatatatggatagaaatcaactggtcaatcagagtattgactatattatgcagcatttagatgaggacttgtcggtggagtcggtggctgaccagttttttatatcgaaataccacttttcccgcatattcaaagcagtgactggcgaatctgtctatgcatttatgaaacgctgcaaggtagatcaaagtgcggttgatatgaaattaaatccggaaaaatcgattacagacattggcctggactatggatacagttcttccaactatagttcggtatttaaaaagcatcatgatgcttcaccagtgaagttcaggcagtccataccaacctctggcatgccggttccctttaccccggagcgcaccgcccatttcaagactgcacaggaatatgcctccagaatcgaaattcaggagttgtctgacttctttgtgctctatgagcggttcatagggaattatgtagaactggaaaagcactggtaccagttcttggatctgtatcaagcctatttgcaggaagaaaccattttagtggaacgttttttcaatgatccggccattacaaattcatcgcagtgtatctgtgatatctgcatgacagtgggagaagagtgtggattggataatcttatgcggatccagggcggaagatgggctgtatatcacttcgatggagaaatcaaagatatttttgagacgctgcaggggattttcaatgtctggctgccacgaagcggctatcgcatggcacagcgctatggcctgaatatttatcgccacatcgaccgggagaaacacagggttcgtatggatctgtgcattccaatttcataagagcaagaattcagaagccagcagggcggccttctttctataattaagaggtattttagaaatgcttcgaaagaaaggaggccatttttgtgtccgataaaatagccgaagaaaaccatgtcatttgggaaatagagtattgcgcgccgcctgccgtgctgcgttactgtaaaaaatgcggaaaaaaagaggagtatctatgttccggagagtttcgcgtcaatgcacagcaaaaaaacctggacatatggctgatctacaaatgtaaccactgcaatacaacatggaacagcgcgatctattcccgcgtttcaccacagaagctaggtgcagatctacttgagagattctacaagaatgatgaatcattggcaatacagtatgcgatggatctttcactgttacatagaaatggcgtggaagcgaaaatgccagagtatacgattattggggaggatgtttcgctggagaagactgttaatataaaaattcagagcaaataccgtctgccattgaagatatctgctattttgcgtaagaagcttggcatcacgcagcgtgagctggaagaactcatcttaagcaaccggatatggagcaacacggggcaagacataagaaaatgcaggctatcatctcaagaaaacacgattacgatatcgaatggaactaagaggaattaataatgcaaactgattttttaaaaatatcatgatataataggactaattaagacgataggatagtgcttaccgatattaacgattaaaattagaattcgatagaggaaaggaactccaatttatatgaacatgaataaagagttatacaatatgatctttaaaagaaaatcattccatcttttccgcaacattggagaggagagtatttctacaaatgaagtggaacagattgaaagggtttatcgcacattgataccgctatgccctgagattaagacagcaatcagaattgtacctgcggctgaaacgacttgcaagcgtggtcaacagtactgtattttactttacagtgagaaaaaagatgattatttacaaaacattggatacctgggagagcaattggatctatatcttgtgtcacaaaacattgggacgctttggtttggtattggaaagacagacgaaccctcctatgaaggacttgattttgtgattatgattgcaatttcgaaaattgatgatgagaagaaattccgcaaagatatgtataaaagcaagcgaaaacccatcgatgaaatctggataggagaaccaatcaaggggattagcgacattgtaagatttgcaccaagcgcttgcaatacacagccctggattgtagagcacgcagattctacgctcaaggtctaccgatataagaaacaaggcaaaagaggaatcatgccagcggataaggtaaccttctataatcaaatagatattggaatattcttatgctttctggatctctgcctgcagcatgaggcaataccctatgaaacgcaattatatacagataatggtttagatcatgagaaaacaatgaatgcagtttataaaatatagggaaccaaacatggaatgctataatgtgcattcttttaacgacgctggccggactgctgtttgcttatagcagcccgacagcgtttaaattttcttcttttcccagttcgtgcttttaaaataggcccagccgacgatgaagggtaagagcggggaaagggcctgcccgatatatacgccggggaatccgataggaactagaaaggccaggagccagctgacaggaagccggacgatggcagcgtctaacagcgcatttatcatggctatatttgcagatcctatgccgatggcaaaagaatcgaaagtatacattgccgcatatatcagactgttgattccgcagcatattcttaggtaaaggattccggcctcaatcatttccggacttgccggatcaaacagcatgatgatccgtcctgcgaatatctgtacaaatattactaaggcaaaagtaatcgaaagattcaggcacagtccgatctttgtcgtctttttgactcgatcgatatgatgcgcacctatattctgtccaaccatggcggttacggcctggccgatcgcccagcagggcatccctgcaaaggtattgactttcagcccgattccggatgcggcggcaacggacacgccaaaattattaagcatgcctgtgatcagaagataagagatattgacgactgccatttgaatcgccgtgggcaatccgactcttaagatggcagtcagtttatctggcttaatggcaaagtttttcagcctgaattggaatataaagtcttttcccttgagatggatcaacgatattgtaagggaaatgccctgcgagaaaatggtggcatatgccgctcctttggttcccatgccgaaaggccccaccaggatgatgtccagcaaaatattgaccactgtcgctacagcgataaagtaaagcgagcttttcgaatctccaagccctttcataatagagcagacagcattatagccaaacacaaataccgtgccgcagcagatgatctttatataatcgcaggcgtcctgcatggaaacggcaggaacgttcagcacttgaaaaaggggcttatatacaagcagccctaggatggtgacaagcagtgaagcaatgaaggcgatcgagaatagcgtccctatggtttcacgctgtccctgttcatcgtctgctcctttgtattgggcagccagtacggtaccgcccatggtaacgccgatacatatggaattgatgataaagcttatcatggaagcattgctgattgcggcaagccctgtctttcctacgaatctgcctacagccagcatatctgcgatactataaaaggactgcagcagattcgaaaacagaagcggaagcgcaaaccggattaatttttttgaaacacttcctgttgtcaaatcgtgttcttctttcattggattatttcctttcttttttacgggtaaaatacaaaaggcagcagacaaaacattgcctgctgccgaaatcgcatacatacttaatttatgaaaccgtaccaaaacaaatcccaaacaaaggagttgtctcggagtacgttatttcataaaataaattctttattaggctccgcacaatgtcttggaatatacagttgttcggagctgccatcaatacaaaattttccgtatagcttcatcgtgctcaccctttcctttgtttaatagtttcattatagacaatcaagagaatactgtcaatacagcaagaaatgtgaaaactctcaccggcttattcccatctgaagaactttatggaaacacctccgcaaatcagtaaaaacgtaagcatgacgatgatgggaagccatacagattctaagggcaggccgagggatatcgctttcagaagtttgattccctgggtcaatggcagaaaatcagatgctttctgcatcgcggaaggcataacttcatagggcagcgttgcgcctgaaaagatcagcatgggaaaatacaggacacaggcggcaacgctggctattttttcattcggggataggccgcccaccatcatgccaatactgaatgtggacagcatgaccaagagataggccgcgaaaaacagtccccaggatccgggaaaacggaattcgaaaaacagtgccgctacaaggatgagcaaggccagcgataccagagaatacagggcatagatcgcaacctgtaccgccaggagcaacgcagggcttgtgggcgttaccttgaagcgtttcagaatttttttctgacggtaatcagagatgaccagcggcaggcccatgatgccgcccgcgcaaatcgcgatcgtagacagagccccgaaggattgctgtaaaaatgtgtactccgagccgggagcagcgggcttatttccataaatgacgcccagaatcacgaccacgaccacaggcatgcaaagtgcgaaaataatcatatccatcccacgaatggaaagtttcagttctgttttgagcatagtaaaaaatttattcatcgtctgcctcctctccagtaaaccatagatacgcatcctcaaacttttcgcagcagctttgctccatcgcttcctgcaccgtcccggtaaagacaaagcgaccgtctcttagaatgctgatccggtcgcaaagcatttctacctcgtccataaaatgagaggaaagaaaaatggtcagtccttgctcttttaattctaacagacttttccacacattccgccgggcttttgtatcaaggccggtagtaagctcgtccaggaaaaccactttaggatcagcgatcagggcaagaataataaaaagtttctgcttctgccctccggaaagttcagtgacaaaggcatttttcttttctgccaggccaaatctgctaagaagtggctcatattccgccggctgcctgtaaaggcaggcagtttcctcgcataattcctttacccggattttatccggataattggactcctgaaattggacgcccacctgttcaaagatcggcttgcggtccttatgcggatctaagcccagaatacggattttcccggcatccgccttgcgtgtgcccaatatgcattctatggtggtgcttttgcccgcgccatttgcgccaagcaggccgtaaacttcgcctgatgaaaccgttaggctgatgttatcaattacttttttcccggcgtaggatttacttaagccggatatctggatcgttgtctcatccatgtttgatacctcccttttgaagtgttggatcttaggctgcgcagcgcgtgcctgtttgcaggacatggattttggatgtcctgtggatacaggttagcacttcttcccaggctggtggctaaatgtaggcttttatccagacattttcttcatgatctcgatctgaccggccacatagatggcgttctcgccggcttcttttaaagatgtaagcagccggtcgcaggcggtaatgatatcatcattctcgcttggcgtatctatggcttcccggatattgaccgctggatcatcggacaatgcccgcagcattcgtagtatggcagatagggaataattcgcgcagcgtaaggaacggatgatttttagcctctgcaagtcctcctggctgtatattcgatatccattttgggatcgtttaacagtaaaaaggccgtttaattcccagttccgaagcgtatctatcgttatatggagataatcagcagtctccttcctgttccaataccggtctgtctgggcgtgtttgttcccaatgccggataggatatcgcgggtgattcttatcgcttcttccgcattttctttttccagctcaatctgttccatgtacttctttgtcaatgccgcggccttttcataatcgcccgcggcggacaccttgatgatttggacggcctgcttgcgcagcccgttttgcagcacctctaccttaagcgccgcacgtgccagtttaaattgctccacatgcagatctgtaaaaactcgatacccattttctaatcgttctggcttgggtattaagccgcatttttcatacagccggactgtatttacatgaatgccgatcattctggcaacgtcgattgtcctatactgattcaacctgctcacctccttgttagattatcgcataccatataaccctggtggaatagtgtaggcttataaatttgtggaaataaatccctgctgaataggtggaacgagaatgatagaatagattatccgaactatccagacagtacgctaaaagagaggaaatatcctgtcaaatcagttataattaggaaacgtaagaagaaaggggagcagacatggagtgggatgaaaaattgcagctgatcgtggactacatagaaaaacatttgcagcggatgcaggaaccgatcaatccgcaggaggttgcagagattgcaggatgttcctttggatttttccaaaaggtattctcgtatatgaatggcattagtttttcagaatatgtacgttccagaaaacttacgttagcgggatatgatctaaaaagcacggataagaaggtggtagatatcagctatcaatatgggtatgattctcccacctcgtttacaaaggcattccagcaatttcatggcttaacgccaaaggaagcgcggagaggaaacgcgagactacgggtagtgcctaagatgcagatgtccgtaaaacagcaatattcctggaggctggaagaaaagccggccttccggctgataggaaagagcatccggtgttccgatggagagcagtataaaaaagtaccggagttctggagcgactgtcaaaaaaatggcacgttttccagattagtcactctggataacatggcacaggtcggactgtttggcatattccaatatgtaaagcctggttcttcaaaggaaatagaatattctatcatggcagcatcggatggagagttgccggaggggttccgggagatatggatacccgaatccgtatgggccgtatttgactgcaagggggccgtcccccaggcgattcaaaatgggtggaagtatctggaggaggagtggcttgcgaaatatccttttccacatgcaagctgcccggaactggaatggtacagcagtggaaactcttatgacagggattatctgagccagatttggatcccagtgatagacgagtcactataaatgtgaaaatcaaaagcaggaggacagacatatggatttacctttttatatagaaaacagagacagttttcgcgttgtcggatacttgatgaagacgacgaaccagaaggggcaggggagaaaagcgattccgctgcattggtcaaactttcgcaaggacaacctagaaacccgtatgcttgcattagcagaacagaaggctgatggattattcggcattaatctctataatacggatttggcggattccaggaaattcgagtatatgatagcggttccaagcgatgaggaggcaccggaagaacttaccgaatataccgtaccagccatgacttgggcagtatttccgtgcaccagggaaaccatcgggaaaaccgaaggtcaggcaatcacgaaatggctgccaaaatcgaaatacaggccgttaaacaaaggctatatcacaggcaggatgaagtctaaagcgcctgatattgagtattatggcaaggatggctatgcagaggtctggattgcagtaagagaaaaataaagatatcatgaatcaattattggaggatgaattgctatgaataagataatagagtttgaggagtttcttgcttcggtttccgaacagaatcaggaattcgtgaaggaattacataatcaattaatggaatctggctgtaagatcgagataaagtcagcaaaaagtggttatatagtttcttacctgtatcataagaagacaattgctaattacgtattccgcaaaaaaggaatgcttgcccgcatctatggagtccatgtcaacgagtacgaagaggttctggaaacgctgccggatgaactgatccgcgcaatccaggctgcgccgatctgtaagcgtctggctgatccagatgcctgcaatcccaaatgcgcaaaagggtttgaattctggctaaggggcgagcactaccagaaatgccgtaacagcgcgtttatgtttttggtctgtcctcaaaataatccgtcgatccggctattgctgttgaaggaggtagaggcatggaaaaaatcccaaaatttattttagtttgggcagaatctggcttagcaattccatcgcgctgtttaactggttcagttcttccccggtaagctgttcttcaagcatatggataaaggctgtatttttaagatgatattcgtcaaggtaggatacagccttggaggtaaggcggatctggatggatctgcggtctttttcattatgcgcccgttctacaaactggtgggaacagagggcatcgattaatttcgtgacctgctgctttggcactttcaattgttccgcaagctgcgtcatagacatcgtcccattcattctcaatgtctggaggcagtaatatgtttccaggctcatctcccggttcagggtatctttaaaagggcgcaccagtttcgaatgccagcctggcataacctttagcagattctgtacgaatttctccgatttctttcccatcatctttctctctccattgacaaacgtttgtgaaaatgttattgtttaaaattagtaaataaaatatgactatcatatttaaataactaatctgagtatataatatttgaacagaaaatgcaataacttatggcaggttattgctaatcaaaggaggcagttcgcttaatgaagcatatcagtctaaaagttcccgaagtaatccgccgcaatttccgtttcagcacgctggattttttatttattattctatatgtaaatgtatttcaattcatcttcggtcccgaaaattcaatcgtcggcgtcatctttactatcatgatgtcggcttccatggcacgggatctcacagccacccccttcaggcatcttgtgatacaggcgtttattttgatctggatggcgcttgcgtcttattgggtggtcctcttgcctgcgccgatttcatttacgataaattttgtcacgttactgatcattttgtatgtgttcacttatgagtattccagtcacttatattttccttatatattgtcctatctgttcctggtgtttatctcgcctatcaatgcgcagcaggttccaaagcgtctcgctgccatgctggcgggagcgctctccattatgctttatcaatggtttatggggaggaataaggtggtggagacggccagagatgttcttacggaaatgatcgacgaagtctgcaaggcttgcacatacgcagcgggagaaacttcggagaaaggtgatagaggaatcatgcggcgcaaactgtgccggctggggcatacggtatatgaccgaaggaagaaggcgctttgcatttctgatgccagtttctctatgatagcggcggggcgggggcttgaacatttgctgattcttataaaggaactgtcggaaactctctctgaacaggaaaaatcttcacttctatatatatccggacagcttaagatatatcgtggcttcctgagtcaggagacggatagcctgcctcctgtggatacgacaatgtttgctggaattgaggagggcaaagcagctttacggttgtatcatgcggttttctatatccgtgacaggctgctgcatatgacagatccggagaacaagggccgttacaaaaaaacggctctgtctctgaaaacgcgtctggaaacggccctggactttagtcctgtgagggccatatatgcagtccgaacggcgctgcttctatccctgggtaccgtgctggtacaggcaatggcgcttccccatgggaaatggctgctttttaccctggcctccgtctcgctgccctatgcagacgacgtgccagtgaaaattaagaaacgtgtgttggccaccattgccggaggattggcctctgtactcatttactctttcattccctggccggcgggccgcactgcagccatgatgatctctggatacatatccttttattttacagactatgcacagacctttgcctgttccaccgtcggggcgataggcggggcagtatttatgcatgccttcgggctgcaggatgtgggcagcatgttcctgatcaggatagggtatattttgatcggggcttccataggatatctggccaactgtctgatatttccttataaaagagcacgggctacaaggcagttgtggaaaaaatatacttccgtgacagaattgctatcaagaattacccggaaacagcagatagactcccaattatactataatctggtggttcagtcttatctgctggaagaaaaattaggccagaatgctaattttgagaagtgggaggaatttcccaaggttctttcggcccatcagaagaaaattctctatgtccacaagaattcaaattaagatatcaatatggaggatgtttcagactctttggcaaaaaataaaagcgagagtggaatttattctgcattatgttatactaaaaagatcagaagaatggagagattaaatgaaacgaatttttttggtcgaggatgataaagaaattgccaagaaccttgcgctcttgcttcgcacggaaggatttaacgttacccacgcctcttcgcagggcgaagccatatccgttcttgacggaaaccggtttgatctggcgctggtagatatttctctgccggatggaaatggtttcacggtctgtacggagattaagcaggcgcagaatattcccgttatttttcttacggcttccggcgatgaggcgagcgtggtaacagggcttaatatgggagcggatgactatattatcaagcctttccgcccgcgcgagctgactgcgcggattcgtacggccttgcggaaatacggaggctcgccatcggcttttgaaatgtgcgatctacatgtggataccgccagcggcgttgtgaaaaagagcgggcgggaggtctttttatccgccttggaatatcggctgctgcttatatttatcaacaaccctaatgtgatcattacgcgggaccggctgttggacgaattgtgggacgcggcaggcgagttcgtcaataacaatacccttaccgtttacattaagcgtttgcgggagaagattgaggatgaccccggaaatccgcagatcattctcaccgtccgggggacaggataccggctgggaggcagttatgtttcggaatagagaaatacggtggtttgctgttttatttatttttattaccgtggccttagctgcggcaggatttgccatccatccggcagcagggatactggcctttgtctctgccgctgcttttggcgcggcattttttgtatttaccagatcccggtataaaagcattgctcagatatcagaacagatcgatctggtgcttcataatgcagatcatctgtttgtcagcgaggctcaggaaggcgaactatccattctgcaaagcgagatcaccaagatgaccgtgcgtatccgggagcagaataatgcgctgaaaggagagaagaagcatcttgctgattctcttgccgatattgcgcatcagcttcgcacgccgcttacttctgccaatctgatcctgtcgttgcttaaaaatactctggatgagaacgagaggaagaatctgctgcgggaagtggaaggcttgttcgtgcagatggactggctggtcacatctctgctgaaactttcccggctggatgcaggcatcgttgtattccagcgtgaacagatggacgtcggcaatctgatagatgcctctatccggccattgctcatatcaatggaacttcataatattgacttacagacagatataccggaagggatagtcatagaaggggactctgggtggctttcggaggcaatccaaaatatccttaaaaattgtatggaaagcgcaggcgataacgggaagattgaaattatgtgcgaggataatgcgctgtttaccgagattactctgcatgacagcgggccaggctttgaaaaggaagatctgttctgcctgtttgaccggttctatcgcgggaaaaatgcgggcgcggtaggctatggaatcggactggcgctgtgtaagacgattatcacccgtcagggaggcacgattgccgtaaagaaccatccgcagggcggcgcagtattttccattcgcttttcaaaatgatgaatttatatatgaaatgtctcccctaatggctgtcgaattttcgaagttgatctagggcaaatatttgaagaggaacagggattatggaaagggcctgttccttttttatttccggggcagtttggctataatatctgtttttttcatgaaattgtacataatactaatggagaagtctggatgcatccacttatcagagatattcttgaaagatttacttgactcttttaactgtaacatttataattacatttatagggaacataggaaaagaagggtaggatgatatggaggaaaaagagaagcagaagcaaagagcggcagaggcagcagcaaggcatcttcaggatgacatgacgattgggcttggaaccgggtctacagcctattatctgattctggaggcaggaagaatggcgaaggctgggatgcggctaaaggcagtgactacatcgaaagcaacggaagaacttgcacgttcacatcacatttccgtaatactcccggaagaaacggattgtgttgatcttgccattgacggcgtggatgagattgaccgggagtttcgggcagtaaagggagggggaggagcgctccttcgagagaagattgtagcgtccaaggcaaaggaagtgatctggatcatggatgagagcaagctggtggagaggctgggagcatttccgcttgcagtagagatactgccatttggatacgcatggacagcgaatgcgattctggatctgggatgcgcggcaaagatcagaagccaggaaggacagcagttccatactgataatggaaatcagatattggatgtgaccattccaaaggagttggattatggcagggtggcagagacaatcaagggaattcccggcgtgctggagaccggctactttgaccgcgcatgcagccgtattattatcggtaccagccaggggacagaggaacgtgtcaatcctgccagaaagggaagtctgcttcgaataggaggaatcataaatgaggaataaaatagataagtcagaagtttatgccgggacatattattcgcaagacagcctaggggtctatcatttgatattgaatgaagagaccggggagatgtcaaagccggaactatgctatgaagcgcccaatgccaagtgggtatccctcttgggagatcgtatggcagtcccggttgaaagagcgggagcgtcaggaacttgttttctggaacttgagaaaggaaggccaaaactactcggagagattctggaagaaaagcagactccctgctatatcctgcaggacgaggatggcatctatactgctaattaccatgaaggcacggtaatggcatataagttcaaggatggaaagccttttgtgataaagagaatagaaaatggagaggaggccggctgccatcagatcttgcggcatggcagcgatctgctggttccctgccttaccagagaccggatacggttctttgacatagagcaggggtatgttccttcaggggaactggtctttccggagggcacggggccaaggcatggggtgttcaatcatgatcacagccgcttctatgtgacgagcgaatggagcaatgaactttttgcataccaggtgcaaggcagggagtttcggctggtgcaggctctgtcggtgcttccggatgacagagggaaaagggaggcggcctgtgcggcgattcgaatgacagcagatgagcgcttcctctatatttccatacgtggactggatcttcttgcggtagtggatatcagccaggagcaggcaaaaatagtgcagcatgcttcctgttacgggatacatccccgggactgcatcctcagccggaacgagaaattcttgctggccatcaaccgttatgcgggtggaatcgtaagcatcaggcgggatgaaaaggacggaaaactgcgggaaaaggccggacaggcgattctccctcagggtgtatctttggtactaaaatagggaacctgttaattgaaatggaggtagtggcatgtatagaacagatataggagtcatcgggctcgcagtgatgggaagaagcatcgcgcttaatatggcagatcatggattcaaggttggcggatataaccggagcagacaagtgacagaacgtctgatagaggaacatcctcatgagaatctggttcccttctatgagttgaaagaacttgtggcctcccaggagcggccacgcaagttcctgatcatggtaaaggccggtaagccggtggatcttgtgatcgatcagctatcccctttgctggatgcgggagatatgatcctggatggaggaaattctttttttgaagatacgagaaggcgggaacagcagctgcgggaaaagggaatctattattttggaaccggcatatccggcggagagaagggggcccgttttggaccatcgatcatgccgggcggagatgaggcggcctatgcgcatattgctccgattctggagaccatagcggccaaggcaaagggcgagccatgctgtgcctatatggggccggatggtgccggacattatgtgaagatggtgcataatggaatcgagtacgcagacatgcagctgattgcagaagcgtaccttttgcttaaatacgccggtggattttccaatgaggaacttgcggatatgtttgcccggtggaatcaggggaagcttaagagttatctgatcggaatcacggcggatatcttccgggaaaaggacgattttcaggatggacagctgattgactatattctggacagcgccgggcagaaaggcaccgggcggtggaccagcctggaatcattgaagcagggagtcaatgtatctttgattactgccgcctgcaatgccagaattatgtcaaacaggattgaaaagagaaaactggccaaagagttgattcctgaacccaaaggaatatctgcgcctgagaaggcagtcatgaaggaactggtcgagcaaggtctgtatacggctaagatcacagcctatgctcaggggttcgaactgcttgcccacgcgtcaaaggagtatggatggaatctgcgatatggcagaattgccgcgatattccgggcaggatgcattatacaggcggaatttctggaagacatcacaaaggcctttgagaaaaatcccgaattagataatctgatgctggattcatttttcctggatggcatcagaaaggggcaggaaagcctgagggaggctttgtgcattggcatcaagaatggaattcctctgccggcgatgagccaggcagctgcatatattgacgcattcaggggcgttcccgcaggagccaatctgatccaggcgcagcgagactgctttggagcgcacacgtatgaaagaatcgacagagacggaatattccaccacgattgggggcaggaccatgaataaagaaaagacatttaccatattcggaggaaccggagacttgacgtttcgaaaactccttcccgcgctttataatatggaagcggcggataaagagggacttagcacgcagatcgtcattgtcggaagacgggattataccagcgagacctacagggatctggctcgggagtgggtggagaaatttgcgagacttgcttatactgtggaagtatatgaaaggttttccaggcggatcatctactaccgcatggatattacggaggaagagtcgtatgaaggattgaatgaattctataagaaaatagaggcgaaagagcatatcttctactttgcggtggcaccgcgcttctttgccgggattgtcagcgggctaaagcatatccggggagcctgcgagggaaaggtcgtgatcgagaagccttttggggaggaccttttggctgcaaaaagtctgaatcggacgatggaagccttctttacgccggagaatatctatcggatcgaccattatctgggaaaggaaatggtgcggaatatccagacgatccgctttgccaaccctatattccagaatgtctggaatgcagagtatattgactgtatccagatctctgcgttagaggaagtcggggtagagacaagagggggctattatgaccatagcggagcgctaaaggatatgatgcagaaccatctgttccagatcttgaccatcgtggctatggagcggccgcaaagccccgccgtagaagagatgcatcaggagcagatgaaggtgctggctgcgcttaaggctccggaggaaatcgcagagaatatggtgctgggacagtatgaaggctaccgtcaggaaccttccgtgaaggaagactctgtgactgagacctatgcggcggtacggctgttcatagacaatgaccgatggaaaggcatgcctttctatatccgtaccggcaagaagcttggaaagcgggagatgcaggtggcggtcgtatttaaaagcccattgccggggctggagccgaatatcctgaatataaagatacagcctacagaaggagtctatctgcagttcaatatcaagaagccgggagagtcagacgataccatccaggcgaagatggacttctgccagagctgcttgcagatcaatcagatgaatacgccggaggcgtacgagcgtctgatcggcgcctgcattctgggaaaccgcgcgtggttttcccagtgggaccagatcgagaccagctggaactatgtggatactattcgcaagatgtacgcggagcgcgggctcttagcctatccgtatccggcagggagcaatgggcctgtggaggcagaccgcctgcttgaaaaatatggtcatgcgtggtttgactaatccatgcagccggggatatcatgcttgacaaatgagcaagggaatgctattctaattgagttcaagatttaaaagtgcctaaaaggctataagtttttctgtttctgagataaacagaaggggcttatagtctttttttgtacgagaagaattcaatatcaggaggtttttattatggataaaagtatagaggctatggggaagcggccaatctttccgctgcttctttctatgtcctttccgccgatgctgtcgatgctgatacagtccatgtataacataattgacagcatctttgtggcaaggctgggggaggaagctctgacagcagtatctcttgccttcccgcttcagaatctggtcctttctgtggcagtaggactgggagtaggattaaatgcgctgatggcaagaaacctgggagcaggcgatgtaaaaaaggccgaggatgcggcggcccatggaatcgtgctgacgacgattcactccctggcattcgtcctcattggattgtttctgactaagccattttttcatatgtttacgcagaatgaagcggtatttaacatgggctgccaatatacatatctggtaatctgctttgcggcgggaacgctgttccacattgctgtggagaagatgttccaggcaacaggcaatatgatcatcccaatgctgatgcaaggattgggagcaatcatcaatattatactggatccgattatgatcttcggactgcttggggttcctgcgatgggcgtgaccggagcagctgtggcaactttgatcggacagttttctgcctgtacgctgtccatcgtcctgttcgtgaaaaaggggcagatcgcgcttcgcatcaagggattccgatttgacaggaacatagtcagaggcatctactccgtggctgtgccatccggtgttatgtgtgcccttccatccattctgatcggcacgctgaatggactgctggcatccgtatcccagagggctgttgccgtcctgggcatctattttaaactgcagacctttgtatacatgccggcaaatggggtggtgcaaggaatgcgcccgatcatcagctataactatggggcaggggatcagaagcggatgaatgagacgatccgcacagcctgctttgtgatcggggcgatcatgtgcctggggactttgctgttcatgggattccctggcgcgatcatgcagatgtttgatgcaggagatggcatgcgttccatgggaattgtggccctgagagtcatcagcacaggattcgtcgtgtctacgctgggagtcgtgttttccgggacgttcgaggcgcttgggatgggattcaaatctttgatcatctcgctccttcgccaattcgtcataacggttccgctggcaattatctttataggaccgtttggggtcagcggagtctgggccgcatttccaatcgcagaggcagccgccgctgctgcggcgacaggactctttctatctgcccgccggacattgcgcggcagggttcagaaggatggagataattaatggctaatggcgcggggaggcgtattcgtctctgagcgccagaaacaggaagacaagggcaattgttataatgatatgcgcgatgccggcaaggccggatatggcggcattggctgccgggccaagggaggctgccgatacctgggcgatgccgcggacatacagcataatcaccatgaaaggaagcccgatattatataataccaggaataccttgaatttccggctgtcagccaggtcagtctgtcggcaaaacagcatcaggatcaggaagagcatcatgccgaggaccagcagatgaagatgggtataggcaagggctgttctcccttcaaagcccatatgcttcgtatactcccggtagaatacgccgcttgcgatacccaggataaagtaggtaaaagaaaggttccataattttttcataacagatcaactcctttgtaattgtgcctgcatgtcccgaaagcctatgacgattgtccatacgtaagcgcaagtcttaggaatcatcagcattccaatggctggcatggtatccgcgaacaggactacaggtatgtaaaatgcaaaacttaagacaatggtaagccacatgtggcggaacgaacggtcatttcttttttttgcctgctgatagaagaggaggatgacagcaagtcccagcatagcaaaggggatattccggtagatgccccaggataagggagcctctgggctggtccatgcattctggggaaagaggcataacgcgattcttaacaacgccataatatagatcagaagggtcagcgtattctgaccctttatctgatagcggagcctccatacataatagagcagtatgtagaaaagggtcatggtaatagaagtgatgaatttgccaactccaagggcggccgtgtaatccgcaaggcctgtggtacacagcgcgtatgcccggggaaccagatggaaggcatcgccggcccctaaagtgactgccatgattccaaatagcagatactgtgggtttccatggcttttgcgaatcataagaattcccaaggtgataacagtaaccagataaatgacatcaaaggatgtctccataattgcttgcattcttttgctcctttcgcccggtacgactgtgcttgacgtacgtaaaatagttgtaagtaaatgcaattccagccagaagcagggctgctccaaggccagaataaaagaccgcgatgaagatgagaggacatagatgtaaagtgcgcaggccgattccgaaagtcatcataaaggccatgatgcaaaaggacttgccatcaaagaactttagaaaaaactgcatctcttcttcataatggataattcgtccggtatgtttcctgacgagttttccaaaaaccagaaaccagaagactgcgaagatcacgcaggatatcaggatgtttatggctgtcagataatcctggtaggaaatgacgccgatgcgcaggatattgaatccggccagagaccatatcatgcctgccagaagcagcaggtttttctttcttattttcaaatcggatacctctctttctaatagatgcagcgagccgcgatttctgccagcggacgtaagtcatccttgccatttagcagcatggatgtaaatgcggtaaagataaattctataaactcttctttcgtcaggcttgcattaaaagcatcctgacgaatatccgggtcctggtccaggacgcttaaaagtcccattttcatatggccgaagtaatgttccataatctggcggcccttatccttatctccagcagcaaaactgacggaatgcaaagtaaagaatccagggtacttggcacagcctttttgaacactttcaaaaagccatgcaagacagtccgtgaatgactgaaaggcaaaaggagtgcctgacatatggaagatatctctccagacctcttcgacggcagcaccgatcaagtcagcctttgacggaaaataattatacagagagcctacggcgacgccgcaggcagcggcaaccgaacgcatattaatggaagatatgcctttttccataacgattgcgcggcactctgccagaatggcctcttttgaggtgacgatcgtattcataagattacctccttaaattgaacattgttcattatatgcgattatgcaaaatttgtcaagcctggcacaggaaaaggaggataacagattggggaaatttgacaattaagaggtacctctctataattaaagaggtacctcttgaaatgaatgatacgacaaaagtcgaggataggagagttaaatgagtatcaatgatgaagacattatagaactatttatcgaagtagaaaagttagataagagattcgcccgcaggctttctaataggacacagcattgcgagggacagcacagatgcatccttattctggaaatgatgggatctatgaatcagagaaaactggcggatgccctgcatatccgttcgacatccttaagcgaattgctgtctaagctggaacggaaagggctggtagaaagaacgccggttccggatgacaagagaagccttatagtatctttgacgaaagagggcgcgcaaaaggcaaaggaatataaccggcgacgggccaagacacgtcaaaagatcatggatcatatctccgatgaggagaaaagacagttctacagcactcttaaaaagattaaggaaaattacctggagatggaggcagaagagaatgagtaatgcatgcaggcttacagatcgaaagcgtacgctgatatttttaaatattatgattagctgcatcgcgtccagcatgctggctacggcgcttacgacagcgcttcctccgattattcaggacctgcatgtcagcgtctcgacgggacagtggctgacaagcggttattccctggcaatggggattacgatgccgctgacggcgttcctgattaccagattccctactcgcaggctttaccttgcaggacttgggatttttatgatagggcttcttacttgcgctgtcgcgcctaatttctcagtcatgatgacagcaagaatcctgcaggcatgtggaagcggcatccttacttccatgtcccaggtcgtcctgctcattatatatcctttggaaaagcggggaacgattatgggctggtatggactgtctattggagcagccccggtgatcgcgcctacgctggcaggagtcattgttgacttatttggatggaaatacatcttctatattgttgcggcaatcatcgcagtgtcatttctgtgcgcgctttttgtatttgacgatgttttggatgttacgaaaaagaaattcgatgtcctgtcattcgttattagcgcggcagcttttgcaggaatcactctgggaatcggcaatatcggcacgtatcccatattggactggaaggttctgcctttgctggcagcaggattgctggcgggctattggttcgtgcgccggcagcttaaatctgagcagccttttcttgaactgcgggttttgaagagcaaggaatacgcgttaagcgttattggcagcatgctgctgtacctggtcatgatgggctcggccgtaatcatgcccctttatgtccagtcaattttgggatattctgccaccgtctcaggactggtgacgctgccaggctcgctggcaatggcagtggtcagcccgtttgcaggcagaatctatgaccggctggggatgaaaaagttgtttgttacaggcgcgttatgcatgctggccagtaatcttggcatggcctttatcacgatgcagatgccggtgtggacagccggggcattctatgtcgtaagatgcgcagcgatcgggtgtctgatgatgccttttgtaacctggggaaatagccatgtggagaaaaaactgatggctgacgggacagcgcttttaatctctcttagaacaatagcaggtgctattggaacggcggcctttgtcggaatcatgacgaccgttgccgaaaagcagggcgcccggtatggagagaatgcggctatccatggcttgaatgtggcatttctttcaatgtcattcgcaacattaatcttattgctgatagctgttttcctggtaaagaataagaaaacaaatcatgactcctaaaccaaatagaaggtttgtattttaccgtttttgtggtatagttacattaatgaattcgactgtgggaaacggtagaaaaaaggaggattaacatggcattttattatgaggagccatccaggacattcagcgagtatcttttgattccaggctattcttctgtggaatgtgttccatcgaaagtaagccttaagacgccgctggtgaagtttgagaaggggaaggagccggaactgtcgatgaatatcccgatggtttcggcaatcatgcagtcggtctctgacgacaggcttgcaattgccctggcccaggaaggcggcctgtcttttatctatggatcgcagcctatagaatctcaggcggggatgatcgaaaaagtcaagcggtaccgggcggggttcgtagtgagtgattccaatgtatcgccggagatgacgcttcaggatgtgctcgggctgactgagcggaccggccattctaccatagcggtaacacaagatggcagtcccaatggaaaactgctgggaattgtaacgaacaaagactacagggtaagcaggatgactcctgatacaaaggtcaaagatttcatgaccaagctggatgaccttgtatatgcgcaggaagagaccacgctgaaagaagcgaatgacattatctgggagcataagattaactgccttcctctggtcaataaggaccaggaactggtatatctggttttccgcaaggattacgatacccataagaagaatgagtatgaattgatagacagttccaagcggtatatggtaggcgctggaattaataccagggattatgaagaacgggtgcccgcgctgcttaaggccggcgcagacattctgtgcatagacagttcagaaggattttcagagtggcagaaattgacgattgactatatccgcaaaaattatggagaccgcgtgaaagtaggggcaggcaacgtagtagatgcggaaggattccgattccttgctgaggctggggcagattttgtcaaggtaggaatcggcggcggagcgatctgcattacccgcgagcagaagggcatcggaaggggacaggctacagcgctcatcgaggtggcaaaagccagggatgcctattatgaagagacgggaatctacgttccaatctgttctgacggaggcattgtgcatgattaccacattacccttgcgcttgctatgggagcagactttattatgctgggcagatattttgcaagatttgatgagagccctacaaaaagagtaaatattaatggaagctatatgaaggaatattggggcgagggaagcgccagagccaggaactggcagagatatgacatgggaggagataagaagctgtcctttgaagagggcgtagattcctttgtcccatatgccggaagcctgaaggacaatgtaaatcttacgctgagcaaggtaaggtcaacgatgtgcaactgtggagcgatcaatatacccgaactgcagcagaaagccaagattacgctggtgtcttccacaagcatcgtagaaggcggcgcgcatgacgtcatgctcagagataagagataggagcgccaggacgggcgaaaatgcggctgccagtgaagaactgtctgcccaggcccagttattaaaggaattgatagaaaaattccagattgatagaaatgagtaagcaaaaagcctgaattggaggaagtctaatgactgaggacagcaggacaattagccgcttaagacgaatgatccataaggtgctgatcgtagcgattgctctgacagccatgcaggtactgccaatacaggcgcaggagagcaggactatcaaggtgggctgtatcgacatcgaagactttctggttgtggaccaggatgggaatgtcagcggctatgcatccgagtatctagagaaaatatcaaagcatacgggctggacatacgaatatgtaaacggttcttgggcagaatgcctgaattggctgaaggagggaaagatcgaccttctgatgcctgcggaatattcagaggaacgggcaaaagattatctgtttagccaggattactgctgcatggattatgcagccttaatagggcgcaaaaacaatgacaagatttattatgaggacttcgagaattttgatggcatgacggtgggaataattgaaggcaattatctgaacgatgtatttgaccagtatgcagcaaagcatgattttacggtaaataagaagtcgtatgcgaacagcgagtcccttgaagcagcattagaagaaggagaagtagatgctatcatcaatggcaatatgaattattatgatacgcagaagcttctggctaagatcgactatatgccagcgtattttattacctccgtaaaccagccggatctgatggaggaattagatcgcgcccagtatctgatccatctggaaaacccctattatgctgcgcagctgcatgaaaaatattatgggaagattgaaaggcaggccgtgggattcaccagggaggaagccgagtatatcgaaaatgcggatgaagtgaaggtgctgtgcaaagcagacaactatcccttatcctggaaggataaagagacgggagaaatgaagggcatataccctgattttatcaagctgctggaaaagaaaagcgggctgagatttaagatcagcggctatggacctcagagaagcgcattccagctgcttgaggctggcaaggcagatgtccttctggatgcggtatctgcatcttccttaaagaataaaggacggctggcgctgtcggatagtttttatgatatgccatatgtagtgctggcctataaaggagcggataacctgcaagggaagcatttgaaggccgcactgccgatgcaggaggaaaacacagaggcatggattgaaaaggaatatccggactgggatgtgaagttctatgattcctgggaggggtgcgtcaaggcgcttaaaaagggacaggtcgacatcgtaccggtcaatactgccgcatggcagacgttgtacgtattccgggatgagacagaactgatgaatatcacgacgtcatcattccaggtaccgctatgcgtggcaatgtccgaagagaatccggaaccattgatttccgtgatgaacaagctgatactgaaactagattcggaggaagtatcggaatgtatattggagaatacgcttcgcggcgcgcagaaggtgacctttaaggaactagtgcggcaatatcctgtccagatgattgtgattggaatatttattgctgtcctggtggtgctttttatcgggctggcctatatttatcgcctgaaagcccgccagaaccgagccttggaagagaagaacgcgcagttggaagaagcgcataggcttgagaaagaactgacgcataagatggaaattgataagctgacaggcctgtttgataagatcacggctgaaaatagctgtcggaaataccttgtggaaggaggaaccggcgttttactgatctttgatattgataatttcaaaaaggtgaatgactgttgcggacattcgaaaggagatgatattctccggaatgtgggaaagatccttcgtctgttctgccgttcggatgatattgcggggcgggtaggaggagacgaatttctggtattcctcaaagagatgaaagacagggagacggtaagacaaagactggaagtattaaaagggcagataagagaacttggaaaaagcagggaagttgacatcagctgcagtatcggagtagcgtttgcgccggaagatggcggagattttgacagcctgtttaattctgccgaccaggctatgtataaggcaaaaggccagggcaaggactgctataaattctattgacacagggatatgatggacttggcggataacaatatgcgagtaatccggctgcgtgtgcgccagccgcttgaaaggacagacttctgcatttgcaggggctgtcctttttgcgtgcaggaaaataaaggagattacaaagacaaggcttgacatagaaatcttacaagtgtaatattaacaaaagattacatttgtaagaaaaggggacggaagatgaaaaaaacgattttggttattgcattcttactgcttgccgcggcaggctgcgctggcaaaaacacgaaggatggttcaaaggagcatgcagataggaagtcggttgaaattgcaaagagttaccaggatatatatgagaaagcctgcaaggatggaacgttagaggatctggctactatccgccaaatcgtagaacgtctgggggaggatggacttgtggcagtggacgctgagaatcaggttgatatggaaaacgcggcgcaggcggaagagttctgcaaaagagccggcgaaggaaaggaggctgtccagacgatcatcgccgtgaaggatgatggaggatttatgcggtatgacctggaggcttcggagggaacgttaaaagtgaggcaggggtatgtcgcatggagcaatggcgagccagtggaaaaggagacggatgaatatcaggcatatgcttggaactactctgggaaagggtacctgttttttgaaaagtaccagccacccgggtatgatggattttcagggcatacggctataagagtgaagcccctggatcaggactgccgggagttgaaccagaagtatatcatgccggtggggtatcggctgaataatatgtttctggaggactggagcgagaatgactatggcaatttgaacttctatgacatcttcgagcctatgtatcagatgaagtatggaaagaggctggatgtggaatttgcctttacaggaaagacatacgatgtgccggaagaagaattcgaaaatgtcttcctggcattttttcagattgacccttccgtgctgcggcaaaagaccacctatcaggaaggcagtcatacttaccagtacaggcccagaggaatgtttgactttggctctactccggatattccctacccggaggtggtatcttatgaagaacaggaagatgggacgatcaaactcgtcgtggacgcagtatggcctgaccggaatatggagaaggcgtacagccatgaagttgtggtacgtccgcttgatggcggcaggttccagtatgtttccaatcatgtaattgactccaaggataatgctgagcctgtctggtatagggagagactgagtgatgaaaagtggaaggattattatggggggtagatttaacgggaaatgttacttatgacgcgtattatatatgtaataaaggggagcggaggaataaaaattatatctaaaataaatttacggtaatagtattatttttaaaaagattttatgttatactgaatccatgcgttagatatataataaagttacaaggatggataaagcatggcatatggtagatcaaatataaaaaagaatagaagaatacaagaaaaatgcatggcagtcataatggcgtctgtcatttttctttgcctgtttctttcaccggcgggagatcgccaggtcgcggcctcggaggagagtgcggataagacagggcgcgtggtccgggtcggggttgtggaagcgccaggcctaagcgagatagacaaatatggcaaccataccgggcttatcatagattacttgaatgaaattgccaagtatacaaactgggagtacgagtatattgatgtaggagcagaagaattgattggcggattccttgatggggagtatgaactgatgggcggcacctattattctcctgaattagaacaatactttgcttatccggattactctatgggaggcggccgggtgacacttctatgtatgaaagacaatgacgaacttagaagttacgatcttcagtcccttaatggcaaagtaataggcgtctatgaaaaagccggagataagatagaacggctgaaggaatatcttaggataaatgggattgactgtaccttaaagtactataccagcgcagagatggaaaaggagaagaatctctacgactatctggagaacggggatgtagaccttcttatggggaatgaccttgacttggatgacgaattcagggtcgtgacatcttttgaagcccagccctattatatcgtcactcagcctggaaacgaagaactcctggacggacttaacatggctatggagaatatcctggttgcggatccgaattttgcagtagagaaatatgaagacaattatccggaccttaagacggcggacatccgtctggatagcgaggaactggattatatagcgaagaaaaaaacggtgtcggttgctattgttaaagactggcatccgttttactgcattgataatactgccgatcatcataaaggcatgattccggacttcttaagcgagatatccgattacacaggattgaagtttgagtatgtatttgcggattcctataaagaagctttagaattgctgaaaagtggaaaagcggatattatggggggatttctggattccgaggaggaggcgttcgccgacggaatggcattgaccaagtcttatgtcagcttgaatagtattattataaaaaataagtcggctgactatcccgattccgggctggtaggcggaattctggaagggcggactatgcccaaggaaatacaggcagataaagtgcgtacctttggaacatccagagaaggaatgcaggcggtcaacaacggagagatagatttctattatggactgtcggcgcatatggatcaggagatgcagaatcaccgctatgtgaatcttgtgccagtcacgagagtaaacaacagcacgcagatatcctttgccatgagacgtcccgtggatacgaaactttttgtaatattgaataaggcgatcggaaacatatctaccaagactacaaacactatcctggacaagaatctggtgtctatgggatatacccagatgccgctgtcggatctgatatacgcgaatccatttgcgtctattgtgattatcgtcttgttctgcctgatgatcctggccgggatcttcatgattatgcgttcaaaatggaagaatcgcatgatgcaggcggaactggaaaagtcggaggtgaaaagccaggctaaaggcgaattcctgtcaaagatgagtcatgaaatccgtacgccgatgaatgcgattgtgggacttgcggatctggcggagatggagaaggaagtgccagcccccgtcagagagaggcttaggaaaatacattcatcttccaagtatcttctgtccttgattaatgatattctggatatgtcaaagattgagaatgggaagatggagatcaaggctgtggacttcttgatgggagacctgctggatgagatcgaagaaatggtggaacacaaggcacaggaaaataaggttgcattccgccaaaatgtggatatccagcacttctgcctgaaaggcgatcctctcaggcttcgccaagttcttttgaacctactgtccaatgcgatcaagtttacgcctgaaaatggaattgtaaccttgacaatcaaggagcagtcttctaccagtgaagaagcaaggtgttatttttctgtggaagataccggtatagggattgcgcctaaattccagaatataatattctcttctttcgagcaagtgggcacgaatatggcgcagaatgaggggaccgggcttggactgcctatcagcgatcagatcgtacagactatgggcggaaagatacaggttgaaagcgtgcagggagaaggatccaatttttattttacaattgacttgaaattgggcgaagaaaagaatattgagaagaatcttcaggcggaagacattgatttaaatggggaaagaattcttcttacagaagataatgatttgaatgcagagattgcaaaagatttgctggagtgtaagggagcgtctatagaacgcgcatccaatggcgaggaagccgtaaggatgttccttcaaagcagcgagggatattacaatgtgatactgatggacataagaatgcctgtaaaggatggccttacggcatgccgggagattcgtgccagcgtccatccagatagtaagaccatacctattatcgctatgacggcaaattcattcaaagaggatgaagaaagggctatggaggcaggcatgacggcttttgtaccaaagcccattgatttagcgtgtctgtatggagtgctcagaagcgtataaaggcatgcagaagaatagaaatgtgtggaggagaagatgctgacaataggaacgcatatgtcgattgccaaaggaattgccaaaacagctgaaaatgtggtagagatgaaggccaataccatgcagattttcagccgtaatcccagaggctcgaattataaaacctatacaaaagaggagatcggaagattccaggagatccgtcgcaaaaaccagtttggccccttgctggctcatgcgccttatacgatgaatctggcaagcgacaaggagaaggtctatgaatttgcctgtacggtcatccgtgaggatattgcaaggatggatgccctgggaattgaaaatattgtatttcatccgggaagccatacgggcatcggcatcgaggcaggaatccgcaatattatcgcaggacttgaccaggcaattaccggggaagagaacatcacggtgctgctggagactatgactggaaaagggacggaaattggagcgaagttcgagcacttaagagcaatccgggacggggtaagacatccggagcggattggaatctgtctggatacctgtcatgtgttcgccgcagggtatgatatcgtcggaaatctggacggcgtattggaagaatttgacagggtgattggcctggatttgctcaaggcagtccactttaatgacagcatgatgccctttggctcgcataaggaccgccatgccacgatagggtcaggcgagattggcctggagccgctgcttagggtcataaggcatccggcgcttaaggaacttccgttttacttggagacgccgcttgaggatgcagagcacaaaaaagagatagagatgatacgccagaaactctaagcgtggaggaaggaaatgggagcgacgttaaagataatagcacggatacacacggattttccatccaaattcggcattccacgccaaagcgggctggcggatacgcatggattcataatatttgagccaaagttcagaaacccggattccattaaaggaatcgaggagtattcaaggctttggctcctttgggaattttcagagaataaaagagaagcatggaatcccatggtccggccacccaggctgggaggaaacaagagagtgggggtattcgcctcgcgctccccattcaggcccaatccaatcgggctgtcctgcgtagaactggaacgggtggaggcagagacgcccaagggccctattctctatattaagggggcggatctgatggatggaacgcccatatacgatattaagccttatcttccttatgtggatgcctatccccaggccgaaggaggctttgcggatcgggtaagggattattgcctgacggtggaatttccggaggaactgcttaagcgggtgccggcagagaaaagagaagcgctgagacagatactggcccaggatccacggccatcctaccaggaggatccagaacgaatgtatggaatggaatatgcggggcttgagattcgcttccaggtagaggcgggacggctggccgtacgggatgtctatgcaaaagcggacaggaagggtattgattccagcgtgtgaatggaggaatttgtactaaaaatgggtttacacgaacaggatacaggtatataatggtaaccagcagatgatgttactgcaatcacctattcaaaaaagaatatagaagtctttgtggcagggtgcaagtccctaccgatggtatagtccatgacccgcgcaagcggctgatctggtgacctttttgaggaattccagaaccgacggtatagtccggatgagaaaagacattttctgcgtaattacgcccgggacataagtatatgtgccgggttatttttttgaggaggattcagtatgaaccagatgaaagaaacaaccaatgtaactacaggagaaaacctaaaaagccgtgatgacgccaggatgaaggtaaagaagattgcgtttatcggtctgatgggggcggtcagcgcggtgctgatgctatttcgcttcccgatcccgttcatgcccccgttcttatcctttgacctgtccgggcttatggagatgctgggcggattcatgttcggccctatggcggccgcatgcatcattgtcgtgaagatcctgctgcagcttgtgatgcagggaagcttctccctgggaaccggagaattgcagaatctgatcttaagctgttcttacgtgcttccggccctgattatctatcacaggaataagacgaagaaaatggcgattactggtatggcggtgagcaccatattcgtatcggtgatggcggtatttaccaacctgtatctgatcattccgttctatgtcaagttatttggcatgtccatggacgacatcattacgatgtgccggacggtaaacccggcgatgaagaatgtaaccagtatggcagtgttcgggctgcttccatttaatctgatcaaatacggcgttacgtctctggtgacgtttatcgtgtacaagaggctgagccgtgtaataaaaggaattataagcaaataaaggagagaatatcatgaaatttacgttggacaaagacattacttatgagcaggcagtgggacgcatgtttgaaatgcttggcaacagccagatcatggcgctggcatccagcctgaacgactacgttatggtgcgcaatgttagctgcctgttctatgacgagaagatctattttaagacggacaagaacttccgcaagacgaagcagctgcttgagaatccgaatgtagccatgtgctggagcggcgtacaggtagaagggacggcaaagaataaggggctcgtggtggatgagccgggacagagatttgcaaagggctatgagaaatacctgtggcaaagctacaacaagtatagccacgaggatacggagattctgattgaagtgtcgcccaagtatgtagagatatgggacaccagcgatgacgggtatgcattccagctctttatcgattttgagaagaggcagattgaagtaaagccgtatgatcagaagtaaaagaatcgcaaaaagtatagggaggctctattttaggaccgggaaaccggaatcctaaatagggccttttttatttcttaaaaaatgcacttgcaatataccccatatgggtatataatgtgcctgtaaagcgaggtggtacagatggaagaaataaaagaatgctgtcataagaaaaaggagcgttctgagaaagagtataaagatttgattcaccgcctgaaccgtattgagggccaggtgcgtggaataaaaaagatggttgagagcgatacttactgtacagatattctggtacaggtatcagcggtcaatgcagcattgaatagttttaacaaggtgcttctggcaaatcatatccgaacctgcgtggcgaacgatatacgggagggaaaggaagaaaccatcgatgaactggtggcgacgttacagaaacttatgagataggaggcagaatatggaacaatatacagtgacgggcatgagctgcgctgcgtgcagcgcccgggtggagaaagcagtttccaaggtgccgggggtttcctcctgttcggtgagcctattgacaaattccatgggcgtggaagggacagcggggcaggcagacatcgtggcagcggtggaagaggctggctacggcgctgcgccgaaggcttccgaggcgaagggaaaggccgcttccgggacatcggcggcggatgatttcctgaaagataaggaaacgccgctgcttaagaagcggctgatcgcgtctttgtgctttctggtgccgctgatgtacgtgtccatggggcatatgatgtggaattggccgcttccggcctttctggcagataatcatgtggcgatgggattataccagctgatatttacggccgcagtcatggtgatcaaccagaagttttttatcagcggctttaagagcctgtggcaccgctctcccaatatggataccttggtagccctgggggcaggagcatcctttatctacagcacctatgccttattcgcgatgacggatgcccagatgcatggcgacatggcaaaggtaatggattacatgcatgaattctattttgaatccgcagcaatgatcctgacgctgatcaccgtaggaaagatgctggaagcccgttccaaagggcggacgacggatgcgctcaagagtctgatgaagctggcgccgaagactgcgacgatcatcagagacggcatggaggcggaagtatccatagaccaggtgagaaagggagacgtctttgtagtaaggccaggcgagaatattcccgtggatggcatggtgatcgacggcagcagcgcggtcaatgaatctgcgctgaccggggagagcataccggtggacaaggaagtgggagacacggtgtctgcggcaaccttgaatcattcgggatttcttaggtgcgaggccaccagggtgggggaggatacgaccctttcccagatcattcagatggtcagcgacgcggcagccaccaaagcgcctattgccaaggtggcagaccgggtatccggcgttttcgtgccggcggtaataggcatagcggtggtaaccatcctggtatggctggttgcgggacagagtataggatttgcactggcaagaggaatctcggtactggtaatcagctgcccttgcgcgctgggcctggcgacgcctgtagcgatcatggtaggaaatggaatgggagcgaagaacgggatcatgttcaagaccgccgtttccctggaagaagcaggcaagatgcagatcgtggcacttgacaagactgggacgatcaccagcggggagccaaaggtaacggatatcattccggcatccgggatcacagaagaagaattgcttcggatggcctacgggctggagcaaaaaagcgagcatccgctggcccatgcaatcttggcactggcgagagaaaaaggtctttcccatgggcacgaagtggaagatttccaggcggttcccggaaatggacttaccgggcggatgggcgaggatgcgctggccggaggaaaccttaagtttatcggtgataaagcagcggtgaccgaagagatgaagcagaatgcagaacggctttcagaagatggaaagacgccgctgttctttagcaggaacggtgaattggcaggaatcatcgctgtcgcggacgtcatcaaggaagacagcccgcaggcgatcaaagaattgcagaacatgggcatccacgtagtcatgctgactggcgacaacgagcgcacggctaaggcgatcggacggcaggctggtgttgacgaggtgatcgcaggcgtgcttccggacggaaaggaaagcgtgatacggtcgcttaagagaaagggaaaggttgccatggtgggagatgggatcaatgatgccccggctcttaccagggcggatattggaatcgccataggggcaggcacggatatcgccattgacgccgctgatgtggtgctgatgaagagcaggctcagtgacgtgccggcagccattcggctcagccgggcgacccttcgcaatatccatgagaatctattttgggcattcttctataatgtaataggaatacccttggcggccggcgtgtggtacccgctgcttggatggaagctgaaccctatgttcggggctgcggccatgagtctgtccagcttctgcgtggtcaccaatgcgctgcgcctgaactggttcaagatgcgcgacgcaagcaaagataaaaaaattaaagccaaaaagaaagaggaggagacgacgatggaaaaaaccatgaagattgaaggaatgatgtgcggacactgcgaggcaagagtaaagaaatgcctggaggcccttgagcaggtggaggaagcagcggtaagccatgaggaaggaaccgcggttgtaaggctgaatggagaactggcagacgatgtgctgaagaaggcggtggaagatcaggactacaaggtgctggatatccagtagtaaaaggcatttctaaaaattaaataaacagtcagacagtcatattgacacaaaagcattttcttgctaggatagccatatggttcaaaatagaactaaatatggaggcgagaaaatgctttttgatttgtgggatggattatccctgtttaaaaaaatctatgaccagtccttggagccggtctgcaaaaaataccagctgacgcgcatggaactggacatccttttgtttctggccaacaacccgggctatgatactgccaaggatatcatcgagcgccggcggctcaccaaatcccatgtatccatgtcgctcaaggacttagagaggcgggatctggtgcaaaaggaatattatccgggcaaccagaagacggcgcatctgaaactgtcttcggcatccgtccagatggtggcagaagggcagcaggcccagaagaagtttttccagacggttttccgggattttaatccggaagatctaagccggatggaggggtacttcgaaagaatgcgtaagaatatgcagaatgcgctgaaggaggaattatagaatgcttacgaaattgattgtatgctttatcgcagggatcggggcaggcctgggaaccgggtttgccggaatgagcgcggcggcggtgataagcccgatgctgattaccttcttgcatatccccgcctatgaggctgtgggaatcgccctttcaagcgacgttttagccagcgcggtcagcgcttatacttatgggaagcataagaatctggatatcaaaaatggaatcgtcatgatgatttccgtgctgtgcttcaccctggtgggaagttatatatccagcctgatcccaagccacgctatgggcggcttctccgtgttcatgacgctgcttctgggaatcaagttcattgtaaggcccgtcatgacgacaaaggattctatggaggctgtcagcccgaagaagcggttcatacagtccatactctgcggtatgctgatcggattcatctgcggattcgtaggcgcgggcggcggcatgatgatgcttctgattctcaccagcgtgctaggatatgaactgaagactgcggtagggaccagcgtatttatcatgacgtttacggcatttaccggagcggtgagccactttgccatcggtggcgcgccggattggtggagtatggctttctgcatcctgtctacatttttatgggcaagggtggccgccaaatttgcgaataagacgagcccgatcatcttgaaccgtgcgacaggagtcgtgctgtccgttcttggcatttcaattattgcggtgaattacctggcttaaaaatgcctcttttggtcaataatgtcagtaaagacattgattgaggaaagaggaagaataatgaagacatttgaagaactgtataaggatgttcttagcaggaagatatcccttaaagagccgctcccctcggaatataacccgcggcatctggactgtctgctccatccaaagaattatgccccggtcataccttctgtcgagtgcgaggaatgtgcctatgagcgcgcctgccagagaagctgcatctttgatgccatcgaagaaggagaagacggaaaactgcggattaatccctcgctttgtacaggctgcggcgtgtgcatggatgcctgcaaagaagaaaaactgactgccagcaaggatgtactacctgccatgaaggcagtccgggaggccaaagggccggcttatatgatggtagcgcctgcatttcttgggcagtttgatgagacggtaacgccgggaaagctgcgcagcgcgttcaaggcccttggatttacaggaatggtagaggtggcgctttttgcggatatcctgaccttgaaagaagccttagagtttgacagccacgtgaaggagaaaggggattaccagctgaccagctgctgctgcccggtgtggatctccatgatccgcaatatctaccatgaactgatgccccatgtcccgggagccgtatcgcctatggtagcatgcgggcgtatgatcaagaggatgcatccggatgcggtgaccatatttgcagggccgtgcctggcaaaaaagaaggaggcccgggagccggatatcgctgacgcggtggattatgtgctgacattccaggaagtgaaggacatcttcgaagcggctgatatacatccggaagaactggaagatgaccagaaggaacacgcttccaaggccgggcggctttatgcaagaaccggcggggtcagccgggcggtgtcggagatggtggaacagttaagacccgaccggagcatagccgttcatgctgagcaggccaatggcaccaaggaatgtatggcaatgatcaaacggatccagaataaggagacggatgccaatttctttgaagggatgggctgtatcggaggatgcgtaggaggcccgaaagcgatccttcacaaggaagagggaacaaaatttgtagatgaatacgggcaggaggcgccttttaagaccccgcttgagaatccttatgtacggaaagtcctgaaggaattagggtttgagacggtggaggatctggtgacagacgattctcttctgactagagatttttcggctgccaggtaggtaaaatgtaaaagttgtggtatgatataggggcacgcataagagaaaggacaatgaaggaagatgaaccgatactatctcgccccgctggagggcattaccacgcacatttacaggcgggcgtatcacgcctgcttccatcctatggataaatattttacgccgtttctggtgccccacacaaagcggggattcaatacaagggaattaaatgatatcctgccagagaataatgaagggatgaggctggttcctcagattctgaccaatgatgccaaagggttcctgcagaccgtcgagaaactagaagattttggatacgaggaagtcaatctaaacctcggctgtccttccaagacggtagtatccaaaaacaggggatccggattccttgccatgcccgatgaactggaccggtttctggatgaaatctaccgtgggactcaagtcaggatatccatcaagaccagaatcgggaagcatagcccggatgagtttggaaggctgcttaagatctacaaccagtacccggtagaagaattgatcatccatccccgcctgcagcaggacttttataagaatacgccgaatctggaagtatttgcggaggcggtgagagaaagcaggaatccgctctgctataacggagacatattttcggtggcggatcgggacaggataaaggagagattcccggatgtaaagacctacatgatgggacgaggaatccttgtgaatcccggcctggcaggagaactggcgggcgaagagccggcggattggaaacggattcgaaggttccatgaccagatctatgaagattaccaaaggatcagcatgggagataagaacgtgctgttcaagatgaaggaactctggtgctatctggggcatcattttccaggctgcgaaaagcagcttaagaagattcggaaggcggagcggctggaccgttatgaagccgcggtggcggaaatcctgtaagaggctgccgctgcatcttgacaaatcgtgaaggatacggtatatttaatagcgtaaattgaacaggggagcctatggataggctgagaggaagttgcgaacttcgacccatatacctgatttggataatgccaacgtagggacggatgtgaattgattgcggaagatgccctggcattttccgtttttttcgtatcatgggaagttctgcttctttgttcatttgcaaagaaaatgatatagcaataccaatgtgagtgaacgagagttcatgaaggggtacaccaccgcgggtgtatttctttcatgaactcttttttgctgtaatggagagaactgttgcgcaaagacatgaactttggaaggagggcagatgatggtaagaataaacggaaccgaaagagaatacaagcccggcatgtcggtcttacagctgctggaagagacaggatattccatctcgcgcgtggcggtagaaaagaacggggcaatcgtgccaaagggcaggctggcggagacgctccttgaggatgaagacagcctggaagtcgtaagttttgtaggagggggctaggagatggaggaaaaaagactgaccaaagaagagatcaggcaggcgctgatcgagcgccatacgctgccggtccaggaaaggctggagcgtgccagggtggcaattgcaggccttggaggcctggggtcgaatgtggcgtttttccttgctagaatcggggtcggacatctccacctgattgatttcgaccgggtggacatcaccaacctgaatcggcagcaatactttatgcggcatatcggcatgtataagacggatgcgctgagagaggaactagagcagatcaatccgtatctggagatcgtgacagaccgcgtcaaggtatcccaggagaatcttgcctccttatttgccgaagacgggattgtctgcgaggcctttgacgacccggaggcgaaagccatgctggttaatggaatcctggagcattatccggggaaactgctggtggcggcttccgggatggcaggatatggggccagcaatgagatccataccagaaaggtgggaaactgcttttacctgtgcggggacgaggcctcggaagcaggcagagatcgggggcttatggctccgcgggtggctatctgcgcggcccatgaggctaacctgatcacagaatatattatcaatcaagaaattttcaatgaagaagcttagtaggaggagacagacatggaacatatggcaaacgatgcatttgtccttggaggacatacatttgaatcaaggtttatcttaggctccgggaagtattccctggaactgatccaggcggcagtcgaaaaagcgggcgcgcagattatcacgctggcccttcgccgcgccaatgaaggggggatggcaaacatcctggactatattccaaaaggagtgacgcttctgcctaatacttcgggggcaaggaatgccgaggaggcggtgcgcattgcccgcctgtccagagaattaggctgcggcgacttcgtgaaggtggaggtgatccatgattccaaatacctgctgccggataactatgagactataaaggctaccgagattctggcaaaagaagggttcgtagtaatgccttacatgtacccggacctaaacgccgccagggacatggcaaacgcaggggctgcctgcattatgccgcttggcgcgccgattggctccaacaaaggaatctgcacgaaagaattcattcagatactgatcgatgagatcgacctgcccatcatcgtggacgccggaatcggcaggccctcccaggcctgcgaggcgatggagatgggggcggctgccgtgatggcgaacacggcgattgccacggctggggatataccggctatggcggaagcattcaagaaagcaattgaggccggaaggacggcatatctgtcaggcatgggaagagttatggataaaggcgccagtgcatcttccccattgaccggattcttgcaggattaggaggcagttatgagtacagacaatcatgtgaacgaaagtattttaaacagcgatatcaaggaatggcagaaaaagaaccgtatcgaccacatggcctatctgccggggatggaagtcctggaatcagaggtgcaggcacaggtgatcgaatcgatgaatgcctatgattatacaggatatacggaaaaggacgtacgccgggcgttggagcatgacaatcgtacgccggaggattttgcggcgcttctgtcccctgcggcgctgccgcttttggaggagatggcgcagcgtgccagaatcgagaccagaaagcattttggcaatggcgtctatatgttcacgcccatctatatagccaattactgtgagaacttctgcatatactgcggatttaactgccacaacaagattaaccgggcacagttgaacgaggaggagatcgacaaggaaatgcgggagattgccaagacgggcctgcaggaaattctcattcttaccggcgagagcaggagcaagtctaccgtggaatatatcggcgaggcctgccggattgcccgtaaatatttcaaggtcatcgggcttgaagtgtatccgatgaattcggatgaatatgcctatctgcacgaatgcggcgcggactatgtcaccgtgttccaggaaacctataattcggaaaagtacgagacgcttcatctggccggacataagcggatattcccttaccgcctgaacgcccaggagagggcgctcaaaggcggcatgcggggcgtgggatttgcggctcttttagggctggatgacttccgaaaagacgcatatgccaccggaatgcacgcctacctgctgcagcggaaatatccacatgccgagatcgcattttcctgtccccgtctgcgcccgattatcaataatgataagattaaccctatggatgtgcacgagccccaactcttgcaggtggtgacggcgtaccgcctgttcatgccgtttgcaagcattaccgtctccaccagggaatgcgcccgcgtcagggacagcctggtaaatattgctgccacgaagatctccgctggcgtaagcaccggaatcggggaacatgtggaagatcttgagacgaaaggggacgaccagttcgagatctccgacggacgttctgtgaaagaggtgtatgaagatctgctgcatctgaatctccagccggtgatgaatgactatgtctatgtgtagaactgggcctgaggagggacgaaaggatagggggattctcagtaatagccaggacttttatagccgggtgatcgccgtgacgaaccggcatctgtgcgccaggccatatctggaacaaatagaaagaatctgccggagacagccgggggcagttatcgtacgggaaaaggatatggggcctgaagattacgaactactgtatcgccaggtccgggaaatctgtcaagcctatggcgtggcgtgtattgcccatacctatgcgaaggcagcgctgcatgcaggaagccgggcgattcacgttcctttgcatttgctcaaagaaacgcctaagatccggggacagtttgatataatcggagtctccatccatgggaaggaggaggcgcttctggcggaaagattgggtgcctcctatctgacggccggacatatctttgcgacagactgcaagaaaggcctgactccaagaggcgtggaattccttgagaatgtctgcgaggcagtctgccttcccgtatatgccatcggggggatgaaaggggaaattgcctgcgtggaggagatgatgacccatggcgcccggggaatctgcgtgatgtcggaatgcatggggtggtaaaagcgggtttggactttacttttttctctgtatgcaatataatagaaaaaaattccatatacaggaattttaaggaggagtccttttggagagattaaatcaaatcatagccgagaatctgaaagagatacggaaaggaaaaggattgagcctggagcaggcatctgctcttacgtcgatcagcaagagcatgctcagccagctggagcggggggaagtaaaccctaccatttctaccgtgtataaactttcactgggcttaaaagttccggtgaccgcgtttacgctggataagcccaagccgttttccaagaccggcaagtccgaggtcgtgccgttaagcggcgatgacggaagatacaggctctatcccatcttcaacttccgggacggacaggactttgagatattcgatctggaatttgacgaaggagggatgatgcccgggaaccggcagatgaacggaaccagggaattcatcaccgtatactcgggacagcttaccttaagcttccaggatcgggaatatgtattggaagccggggaggcagcctcctataacgctttcgacgattatatctataagaacacaggaaccgggatggtgactgccagcatcgtagtccattacccgaattagaaaggagcattgcagcatggagaatcaaaagcagcgcgtatatgacgcattggacaagttgaaaatcaagtatgaggtggtagagcacgagccggtgcacaccatggaagacatggacaggcttggcctgccggaaaagggaaccctatgtaagaatctgttcttaagagattccaagggaaagaggcatttcctggtgacttgcgaggaaagcaagaaggtagacttaaaatcactgggaaggcagctgggaggagggaatcttagcttcgcttcagaagaccgcctggaaaaatatctgggccttaagcagggcagcgtgtctcccttcggcctcatgaacgataccgaccatgcagtagagttctttatcgacaaagacttaagcagatgcaagagtctgggtatccatccgctggaaaatacggccacggtatttttgtcctttaaggatctggataagtttttgtgggatctggatgtagatgtggtgaagattaagttgtgattttggggaagtagtgacggcttggaggcgggcaggagggattcttccgacgcttctgtggctgcgactcatgcactgagatgttagcctgcgaaggagtcgccgaaagcggctcctctttcgcgggctaacatctcaggcatggattctgcgccccattcgcttccccccagaatctctcctgcccgccttcaagccgcccggtacttcgctggcaatcccgcgaggtgcaggcggttcggtacaccttctgcagggacggaaggtgtaagagatcagatgggcagggatgcggattctaaaatagtacaaatacttcaaagaagattcaagaaaatatcatctttaatacgaaaaaggcccttgaagggcctttttatttgccaatacaatgaaatcattctgctaaactctatacaacgccttggcagacgctcctgcgtaaagtgtacagaaacgccggcacttaccgcagaattgccagtaaattgttggtagcccgggagggaggggttgcgattccggaggtaagcggcggcgtccggaatatccttgccggaactgttagtgcggcaaagaggagtcacccgacgactctttgcgggacttacagttccgtgcaagagatggaggcgccagagcgtcgcaggaatcgcaacccctccctcccgggcgcaccaccaacttaccgaattcccacaccaacctgcttcaaagcctttgcaaccgggggaatggagatgatcgccaaggtgatgactgcctcggcgcccagatatccgccctggtacatcgcggaatatgcccagggattcatgcctttcggagcaaaagaagcgaagaagataacgccggataaggtcgagcagaggaaccgtcccaggacgcctgcaaagtatccaatctgaaggccatattttcggttgctgaaaaaacctgacaggccaagagcgccgaaagccaggggataatccaggattacctgggggatggtcagcatatagggatcaacgatgaattgaagcaggccataggcggcaccagccagcagaccatattttgggccgaaccagtagccgatcagacagatgaacagcatggacatcaaagtgatagagccgcccattggcatttcccatactttgatgtaggatgttaccattgcaagagcgattcccatagcagaaaaaacgagtttcttcgttgcggcgtgtgttgcgccgctttttgtgatacttgattttgacatattatattctccttccttacgccggcattacccggatcaagttcaagggtctgcgcgtcttcgcgcatctcagccatatcggcgccccatatgggtcttatgataggagccatgccggaaattgtcaagtaggagagaaagtttatactttttttattgcaagttaggggaatgagaagtagaatagagaaggtattgatagatgaaagtgaggaagcgtatggaacaacaacagaacagacaggggcagggcggccaggtaccgcctatgaagccggaaagttatggcaagcggctgtggcacctgtggggaccggtcgtaatatggctggtgatcgggatactcgtaagcatgattgcagagtatgctttgacttctgtgtatatagtaagccattatggcaatgaattgaatcaaggaggcagtttcagccagatgatggaattgatggaaaaggacggggcttcgattatggacgctgtcgtcaagcagatgaatgcctattctactccgatcaatggagtgcgggctctgatcgtgattccggttatggcattcctgttccataaagacaggacaaaagagaaggcaaggggatttcaccccaataaaaaagcgcctatctggaaatattttgcagtcattgtcattgccgctgctatgtgcctggggctgaataacctgattaccatagggaatttctcggcggccagcgagacttatacagagacgctggaaggaatgtattccgcgccgcttgctttacagatcgcggtattggcaatcattgtgcccatcagcgaggaactggtatttcgcgggctgcttttcaagcgttttagggaaagtgggggattcatgcaggcagcgctgctgtcggcattcgtattcggatggattcataataatatcgtccagatgatatacggatttgtaattggaatgatgctggcttatctgtatgagaagtatggctcggtaaaggcgccgattctggcgcatatgtctatgaatctattatcagtgctggcgacgaaatacaaactgctggaatggctggcagaagatgttctgcgtatcggaatcgtaacggttgcgtgcgcgtccatagccgccaccatgtttgtgttcatccagagaatagaagagaaaccagatatcccggggaaatccgaagaacatgagaatctggcagctgtataagctgccagattttttactttcataaagcaaatagtctgattgtctgacaattcgagaaaagttacggtttacaagccggggaaaatgtagtatagtaataaaaaattaaaatgaaaggactgaatatatgagcggacagagcgcaagcggtcaatgtggcttgtaccgttccgggtttgaacatgataactgcggaatcggtgcaatcgtcaacattaaagggcaaaaaagtcatagtactgtggcaaatgcattaaagattgtagaaaacttagaacatagagctggcaaggatgccgaaggtaagacaggtgacggagttggaatcttattacagatatcccacaagtttttctccaaagtctgcaagcctctcggcatccttttaagttcacagagagattacggagtcgggatgtttttcttccctcaggatgaactgaagagaaatcaggcaaagaagatattcgaagtaatcgtaaaaaaggaaggcatgaatttcctgggctggagggaagtgccggttaaggcagaggtcctgggaagccgtgcgcgggaatgcatgccctgtattatgcagggattcatcgagcgcccgaaaaaggtggagcaaggcctggattttgacaggcggctgtatgtgatccggcgggtatttgagcagagcagcgatgatacttatgtggcatccctgtcaagccgcacgattgcctacaaaggaatgtttctggtaggccagctgcgttcgttctttgaagacctgcaggatgcggactacgagtccgcgatagccctcgtgcattccaggttcagcaccaatacgaaccccagctgggagagggcgcatccgaaccggtttattgtacataatggagagatcaacacgatccgcgggaatgcggacaagatgcgtgccagggaagagaacatggagtcagagtacctgaaaggagaacttcacaaggtgctgccggccatcaatatcgcaggatctgactctgccatgctggataatgccattgaatttatggtgatgagcgggatggacctgccgcttgccgtcatgatcgcgattcctgaaccttgggccaatacgaagaatatgtcccaggagaagaaggatttctatcaatactacgccaccatgatggagccgtgggacgggcccgcgtctattcttttctgcgacggggactgcatgggagccgtccttgacaggaatggccttcgtccttccagatattatatcacggatgatgacacgctgatcttgtcctccgaggtgggcgtgcttgatattgacccgggcaaggttgttgtaaaagagcgcttgcatcccgggaagatgctgcttgtagataccgtgcaggggagggtgatcgacgatgaagaactgaaggagagatacgcaagccgtcagccttacggagaatggctggacagcaacctgacagaacttagcagccttaagattccaaaccagaaggtcccatcctatacgccggaagaatgcaagcgcctccaaaaagccttcggctattcctacgaggaagtgaagacatccatcctgaacatggcaaaaaatggagtggaagggacggcagccatgggaatcgatgcccctttggcagtgctttcggacaagcatcagaatctgttcgggtacttcaagcagttgttcgcgcaggtgaccaatcctcccattgacgcgatccgggaggaagtagtgacttctaccaccgtctacatcggcgcggatggcaacctgttggaagagcgggatgaaaactgcaggatgctgaaggtggagaatccgattcttaccagcacggatcttctaaagatcaagagtatgaaggcagacggattccggatagcggagattcccattatctattacaagaattccagcttggagaaagcgatcgactacttgttcatcgaggtagaccgggcaatccgcgaaggcgccaatatcctgatcctctcggaccggggcgtggatgaatatcatgtagccatgccgtccttgctggcattgtcgggattgcagcagcacttggtgcggacgaagaagaggacttccgtcgcaattattctggagactggagagccgagggaagtacatcattttgcaacccttttgggctacggcgcttgtgcgatcaacccttatcttgcccatgagtcgatccggcagctgattgatacggatatgcttcagaaggactactatgcggccgtggatgattataaccatgcggtgctttccggtattgtaaaggttgcgtccaagatgggaatatccaccatccaatcttatcagggagcaaaaatatttgaggcgatcggcctgaaggaagcgtttatcgataaatattttaccgataccgtaagccgtatcggcggcatcggaatcgaagaaattgcccaggactatgtggcgcgccattcgcaggcatttgacccgctggggctggaagtggatctgaccttgaacagcatcgggcagcataagtctaaaagcggcggagaaaagcacctttacaatccgcagaccatccatatgctgcagcagtccgccagacgcggcgattatgaaatgttcaagaaatatacggatatggtgaatgaggaagacgcgcacatcaatctgcgcggccagctggaattcaagtatccgaagaaggggattcctatagacgaagtggagagcgtggattcgatcgtcaccaggtttaagacgggagccatgtcttatggctccatctccaaggaagcccatgagacgctggccatcgctatgaaccagctgcacggcaaatccaacagcggcgaaggcggcgaggagattgaacgtctggatacaaacagatgctcggcgatcaagcaggtggcttccggccgatttggcgtgacgtccagatatctggtcagcgccagggaaatacagattaagatggcgcaaggagccaagccgggagaaggcggacacttgccgggaggcaaagtatatccatggatagccaaaacccgtcattctacgccaggcgtaagcctgatttccccgccgccccaccatgatatttactccatcgaagatctggcgcagttaatctacgactgtaagaacgccaataaagacgcaaggatctcggtaaaactagtgtcagaggcgggcgtgggaacggttgctgcaggagtagccaaagcaggcgcgggcctgatcctgatctcaggctatgacggcggtaccggagcggcgccaagaagctccatccataacgcgggccttccctgggaactgggactggcggagacgcaccagacactgcttcaaaatggtcttcgggagcgggtgcggatcgagacggacggcaagctgatgagcggccgggatgtagccattgccgcaatcctcggggcggaggaattcggcttcgcaacagcgcctctggtaacgatgggatgcgttatgatgcgggtctgcaacctggatacttgcccggtgggggttgccacccagaatccgcagctgcggaaacgattcacgggcaagccggaatatgtcgtgaactttatgcgcttcatcgcccagaatctgagagaatatatggcaaggctgggagtacgtaccgtggatgaactggttggacggaccgatcttctgaaagtcagggaagatgccacctccgacagggcggccacgctggatcttaagcagattctgtataatccatatgaagggacgaagacgccggtcacatttaacccaaagaagaggtatgactttgaactggagaaaacgctggatgagaaggttttggtcaaagaattgctgccatctctggaaaagaagcagaagagaagcatagaagtggatgttaccaatacaaaccggacgtttggaactatttttggatctgagattaccaggaggtatccggaaggactgccggaggacagttacgtggtaaaatgcagcggtgccggaggccagtcttttggcgcgttcattccgcagggactgacgctggaactgattggcgacagcaatgactattttggaaaagggctttccggcggcaagcttgtcgtatatccgccacgcagcgcaaaatacaagcacgatgagaacattataataggaaatgtggcgctttatggagcgacaagcgggaaagcattcatcaatggagtcgcaggagaacgttttgcagtgcgaaactcaggcgcgacggccgtagtggaaggcgtaggagatcatggatgcgagtatatgacgggtggacgcgtggcggttcttggaaagaccggcaagaactttgcggcaggaatgagcggcggcgtggcatacgtactggatatggacagcagcctgtacaggaatgtgaataagcagctggtgaatatcgagcatgtgacatccaaattcgatgtaaatgaactgaaaggcatgatagaggagcatgtatcctataccaattcccagatcgggaaagagatccttggtcattttaccggatatctgccaaagtttaagaagatcattccggttgactatgagcgcatgctcaccaccatccttcagatggaagagcagggcatgagcagcgagcaggcaaagattgaagcattttatgcaattaaaggcggaagataggaggcgcaggaaagtgggaaaagcaacaggattcatggattatgaaagacaggataaggcagcggaagcgccaagagaaagaattcggcatttcaacgaattctatacgccgctggcaaaagaagagcaggaactgcaaggggcaagatgcatgtcctgcggcgtgccgttctgccagtccgggcagatgatcatgggaatggcaagcggatgtcccctccataatctggtgccggaatggaacgacttgatctatcatggcaattgggaagaggcatactaccggctgaaaaagaccaacaacttcccggaatttaccgcccgcgtgtgtccggccttgtgcgaggcggcctgtacctgcagcctgaacggggatgcagtcacgacaaaggcaaatgaatatgggatcattgaaaatgcatatgaaaaagggtatgcatcagcgcgtccggtgaaggtgcgtaccggtaaaaaagtggctgtcattggctctggcccttccgggctggccgctgcggacatgctgaatcgcagaggacacagcgtcacggtgttcgagcgggaggataagccaggtggactgcttcggtatggcattcccaatatgaagctggagaaacaggtgatcgaccggaaaatatcgatactggaagaggaaggaatcgaatttgtgacagggtgcaatgtaggcaaagaccggaaggcatccacgctccttcgagaatatgacagaatcatcctctgctgtggcgcttccaatcccagggatattaaagtaccgggaagagacgcgaaaggaatctactttgcggttgatttcctgaaatccaccaccaagagcctttgggcgaatgaaatgcagttaaaagacggcgaatatatttctgccaaaggcaggaaagtcatggtgatcggcggaggcgacacgggaaatgactgcgtgggaacctccatgcgccatggcgcgaaatccgtgctgcagctggagatgatgccaaaagctccggatgaacggacgcaggataatccatggccggaatggcccaagatctgcaagacagactatggacagcaggaggccaaggcagtcttcggccatgatccgagggtttaccagacaacagtcaaagaattcaagaaagataaggaaggcagagtgtgccaggctgttctggtgaaactggaagcaaagaaggacgagaagaccggccggatgatgatggcagaagtagcggggagcgaatatactgtagaagcggacctggtgctgatcgctgccggattcatcggcagcgaggactatattaccaaggcattcaaagtagaagtgaatgaacggaccaatgtggcaacgccggcaggggaatatggaaccaacgttgcgaatgtatttgccgcaggggacatgcacagaggccagtccttggtagtctgggcaatccgggaaggcagagaggcggccagggaggtggatataagcctgatgggctatacaaatatggacatacaataaggaaaattgttcctgcaagatgttacaaaagtgttaaaaaatgttgcaaattttagtgtaatagagtataatcgaatctagatgtaggggtactatgtcaaatgagggtaaaaaagagtataagaataagtaaaaaggatgattaaaatgaaaaaatttggaacgaggctgctgactgctgtcgttgctagttcaatgattgtgacaccagtgttcgcagcgccatcagtcgatgacttgaaggaaaacaaggcagccaaggaaagcgaagtgtcatcgctgcaggaacagttgacggatattatgtccaaactgggagacctggaggaaagcctgattgaaaagggcgaggagattacaaaagcggaagaagatctgaaagaggctcaggaaaaagagcaggaacaatacgaggccatgaagaagcgtatcaaattcatgtacgaagagggagatacgaccgcgcttgagacgctggtgacggcagagaacttctcagatcttgtgaataaagcggaatatgtacagaacgtacatacatatgacaggaagcagctggaggaatacgtagagacaaaacagcagattgcagatcttaagacgacgctggaagacgaacagaagaatatggaatctatgcaggctgaatacgaggataaggaaagcgaactgagttctaccatcgaatccaagaaggcggaagtagcggaccttgactctcagattcaggcagcagccgaggcggcagcggcagaggctcttgcggcacagcagcaggcagcggcaaacaacaacggcaataataacaataataacagcaaccgtaataacaactcctctggaaataataaccatgcgaacaacagcaatagtgcaagcacgggcggcggcacaggcaacacgtctactgcacaggctatcgtaaatgcggcatatggccagttaggcgtgccttatgtatggggtggaacgactccaggagtagggcttgactgctcagggcttacacaatattgccacagagttgcggggattagcatcggacgtacttcagaagtgcaaggaggcggcggaagggctgtcagcaatccgcagccgggagatctggtatgctacggaagccatatcggcatctacatcggcggaggccagatgatccatgcgcctcataaaggagatgtagtaagagttgccaatgtatatggatccccgtggtatagacgttactggtaaatggtaaacgagggaaagtaaacaggagaacttatgagaagaattaagagtgctttgttggtcacggtactgacatgtggattggttgtaacaccggtttttgcagaaccatcggttgatgatctaaagaaagacaaggaagcagcacagagcgaagttgattccttacagagcgaattgacggatctgttatccaagatcagccagcttgagggagacctgatttcaaaaggtcaggagattacccaggcggaagaagacttggccgcggctcaggaaaaagaagaagagcagtatgaagccatgaagcttcgcataaagttcatgtatgaagaaggcgataccagtgctcttgagacattggtatctgcaaaggatttctccgacttggtgaataaagccgagtatgtgcagaatgttcattcctatgacagaaagatgctggaagagtatgttgccacaaagcagcaggttcaggatctgaagtctactctggagacggagatggacaacctggaagacatgcaggcggaattcgaaagcgataaggaaaatctggatacgacgcttgcaagcaagcaggaagagttaggcagccttgacgagcagctgcaggcagcagctgagaaggcggccgaagagcagagacgtcaggaagaagcgcagcaggcgaacaataatggtaacaacaataataacaataataatggcaacaagaagccgagcggcggtggcggcggaaacaatccttcctatgccggacagggaaataccgcggtagcccagaagatcgtgcaggcggcgtacagccagcttggcgtgccatatgtatggggcggggacaagccttatgtaggacttgactgttccggacttgtgcagtactgccatgcggttgcgggaatctcactgccacatttttccgagtcccagtatgccggaggaagaaaagtgtccagtccggaaccaggagatatctgctggaagccaggccatgtgggcatctatatcggcggcggtatgatgatcgaagcgcagcagacgggcaccaatatcatgatcagcccggtgagagcgcaaggctatgcaagatactggtaaggaagtatctggaaattgttgaattatattgaaaataactgaaaaatgtagtattctgaccttaagatatgcaggggagcatatgatccaatcggttgtattaggaactgataagatgaataattgataaggatgggtgagaatatgaagaaaagatttgtacagacactcatcacagtttttgtgatgagttctttaattgtaacgcctgttttggctacgccgcaggaagatgcccagtctctggagacgcagaaggaagaactggaggggcaggcggcagatgtaaacagccagctggtgggccttctggtaagttatgatgccttgcaaaaagatatggctgaccaggagcagaagattacccaggcgcagtcggatctggaagaggcccaggcgaaggaacaggaacagtatgaggatatgaagcttcgcataaaatacatctatgagcaaggcgacacatccgcttttgaagcgctggtgaccgccaagtcctattcggaactggtgaacaagacggaatacgtccagaacgtacatagctatgacagaaagaaattaaaagaatatgtggaaactaaggagaaggtagaagcgcttaagacggaactggaagcaggacaggcggatatggaagtgatggccgcggacttaggccagcagcagacgaatcttgaaaatactctggcagatatgagaagccgtattgccgacttcgattcccagcttgcagacgcaaaggctcaggcggcggcccagcttgatcagctgacggaagccacgcagaatgtagttgcttcggcgcagaccgggaatggcgggggaggaaagccttcatccccggcaggaaattctacgcaaaagccgaataataataccagcaataatgtggctaacaatggaaactccggaaatcattctaactctcagggtgggggctcttcaaacaacagcgttccgccggcttcaaaaccgagcaatgcttctctgggccagcagatcgcgaaccggggatgcgaatatgtgggaaatccttatgaatatggagggacgagcctgactaacggaattgactgctctgctttcgtgcaggccattcatcggcagttcggcatatctacgccaagagactcatgggggcagttaagcgccggaaaggcagtggcttattcggacatcatgcccggcgatgtagtcgtctacagcgatcatgtggcaatctacatcggaggcggcaagatcgtgcatgcttctaacagcaagccataccccgcgggaggcattaagatcagttctccgtggaactacaggacggttctgggagtgcgcagatactggtaatatcggacatggattatgaatatggattgtataaaaagccttgcatttgcgggctttttgtgctattatactatggtcgcaaaaaatcacgcatttgtttgtccgagatggtgccaaagcttggcaacaagccggtttcaaggatttacacatatgcggaagcaaaaaaccaaatggaggaaagaaacatgagcgttatttcaatgaagcaacttttagaagcaggtgttcactttggacatcagacaagaagatggaaccctaagatggctccatacatctacacagagagaaacggcatctacatcatcgacctgcagaagtctgtaggaaaggtagacgaggcatatcaggcagtatctgatatcgctgcagatggcggaacaatcctgtttgttggaacaaagaagcaggcacaggatgcaatcaaggtagaatctgagcgttgtggaatgtattatgtaaatgagagatggcttggaggaatgcttacaaacttcaagacgatcaagagcagaatcgcacgtctgaaagagatcgaaagaatgtctgaagacggaacattcgacgtactgccaaagaaagaagttatccagttaaagaaagaatgggagaagcttgagaagaacttaggcggcatcaaggaaatgaagaaacttccggatgcaatcttcgtagttgatcctaagaaagaaagaatctgcgtacaggaggcacacacccttggaatcccgcttatcggaattgcagacacgaactgcgatccagaagagcttgactatgtaattccaggaaatgatgatgcgatccgtgctgttaagttaatcgtatctaagatggcagacgctgttatcgaggcaaaccagggaatgacaggcgatgaagtatatgaagaggctgctgaggaagcatacgaagaagcagtagaagaataagcgattcatttcaatactaatatatggaggaaattaaaatggcagttacagctagtatggtaaaagaattaagagaaatgacaggcgcaggaatgatggactgtaaaaaagctcttaacgagacaaacggcgatatggacgcagccgtagagttcttaagaaagaacggacaggctaaggctgagaagaaggctggaagaattgcggctgaaggtatcgttatggctgaagtaaaagatgataaagtagcagcgatcgttgaagttaactctgagacagacttcgttgcaaagaatgcggagttccagggatttgtaaaggctgtcgtagagcaggcaatggagacggaagcagcagacatggatgcattcatggctgagaactggaaggaagatgcatccaagactgtaaaggatgcccttacagagaagatttccgtaatcggagagaacttaagcatccgcagatttgagaaagtcgtatccgatggatgcgtagttgcatacatccacggcggcggacgtatcggcgttcttgtagaggctgacacagacgtagtcaatgatgagatcaagacatgcctgaagaatgtagcaatgcaggttgcggcgatgtctccgaagtatgtatcccgtgaagaagtatcagaggaatacatggagcatgaaaaggagattcttcttgcacaggcaaagaaggaaaacgaggaaagcaataagccaaaaccggacaacatcattgagaagatgatcgttggacgtctgaataaggaactcaaagagatctgcctgcttgaccaggtatatgtacaggacggagacctgacggttgccaagtatgtagaaaaggttgcgaaagagacaggcgcgaacttaagcgttaagaagttcgttcgtttcgagacaggcgaaggccttgagaagaagaatgaagactttgcagctgaagttgcggctcagatgggtggaaactaatctggatcttctgagacagtgaaaagcaccgtattccctttattagcaagggtttcgtaaggatgttttttagatttaggatatgcggtatagcatttaaggtgctataccgcttttcttttccaaagagtaacctttttccgttgccttgcgtattcgttcttcaaaaccctggtacaaaaaccgccaaactgattttgaacccgctgctcgtaggagtctttcattttctcaccccccctttcgcaggggtaatcatggaaactgcaaattggcaaccgctgaaaaatccaatcgggcataaatgatgtattgactattgtgtggtgatatatgtgttcatcttgatagccggagtaccccgttggtgggtacaggctttttttgataagttactgatagtcggatattgtcgatataagtctttcacggcgatacctccttagataccgccgtggtcttgcaagtcgtcacaattatgttaagtgcaaaaaaacggcggctctgattattcaaagccaccgttttacgggcgtgagaaaaagtctgctgtacgacggctttttttcttttaccgtcgtgcggctgatactatattgatttaagcaatcattccatccatcacggtgataactctgctgctacattttgcagcctccggcgaatgggtgaccatgacaatggtttgcccgcttttttgattaatctcttgaagtaagctcataatttcagccccggtttggctatcaaggtttcctgttggctcatcagcaaacaggatttctggatttgtaattaaggcacgggcgattgctactcgctgctgttgtcctcccgataattcccgtggggtatgctttcgcctatccgataaccccacaatattcagaatgtggttaagctgttttttatggtctttcatttttttaccgtccaaaagcaaagggagcataatgttttcctctacattcagattggggataagattataaaactgaaaaacaaagcctattttttgtcgccttattttgctcatcttctcgtcaccccactgggaaatatctgtaccatttatatgaacagagcctccagtgggagtatccagcccaccgaggatataaagcagtgtgcttttaccagagccggactgccccataatagaaacaaattccccttgcagaacctttagcgatacacctttcaaaacctttgtggtggtgtcacctattctaaaatcttttacaatgtcttttccctcaatggcaattctattggcagatgattgcattttgtatgtcctccattcttttattcaaatttaatttcttccacgagtttcatttttctgctttttaggataggaacaatagagccgagcagggtaaccacaatgccgagtgtgcctgccgctatgaatgtgcctgcatccaattctggtgtcattgcaattttcggacctgctacaaggaaaattgtttgaatttccatataggaaacaaaaatggcaatgaccgcaccaataagccccgaagaaaatccctcaatcaatgtcattttcatgttttggcgattactgagtcccaccgacttatacatggcgatgctacgccgcctttgaatatagttaatcagcagattattgataaccccaacggttgcaagcagtaaaataaagtaggtcatgctttgcatgggtttcagaaatgctcccacagtagataaagcatcagcattaaattccgctactgttcggctccagttagagtgttctccgaataaatctctgatttgaaccataacagcatcggggtcagcagcagtataggcaaggaaaccataggcttttgcaccaaaatccgaaacggcataatcactgggaatgactgcctccacatctgttgctcttgatttaaagctgcctaccactctataagaattttcggtatttccatttgacagagtgatggtatcgcctacggaaagtcctatgcgtttcatagcactatcacttaggataatagaccgttcccccgaatcaaaagctgaaactgcctgctcctgcatggcttcttttgtatagttaagtgcaagcatagaattgtaccattccaaattatcggtagcctccatgcgtgagaaggtcgcaccgttattgaatacatagagaggtaatactttttcaattccgtccatattctctacttgttctataaaactctgatccatttctccatctgcaaagccctcaagttctgcaccatgaaaaacatcactgatataagtagtgacaaagttccccacaacgctaatggcgatgatagcggaaatgctgataaaaagcagcgtgatattctgtgtgatatttttatttcccctcatatttctggcggcaagtttgccctcgttttgaaataccactccatataagcgttccaagactgtggcaatcccattggtgaacagtgggataatcagtatcgtggcggcaatcagacctaagagagaaaaaccacctgccaagtaaagcatattgccggaggcaatttttggtagcagtacagaaataatgaaaagggcaattcccgttccgataatcaaccgatggggagtgtgtttttcttctacagtgccaagtacaacatcctttatgggtaaacggctcgccctgcgtacaggcagccatgcggaaagcaacgaaacaattactgccacagaaaaagaaagaaagatgccggaaacagaaacaacaatggggatttctattccttgcgataacgatttatccatgccttgcaaaattatattgagtattaaaatccccacagggatgcctgctactccccctacacaaccgtacagcagactttccaacagcaaaatgcgagtaacattcttttccgttgcaccaatgctacggaatgtcccgatgatgggcaagcggtctaatgtaatcactttgtagttgctataaataatgaaaacactcatagtcagtgcaaaaaaactaatgaggaagaacggcatagatttctgccttgcatcagcagctatctgcgtttcgttgacgatctgagagatttcatactctccattggtaagtgacttgttcagctctgcaatgaggtcgcttgttctagttccctcggaaggttcaatcaaaatttgactgtatccgtctgcttgtcctaagatttctgctaaggtggaatacggcaaaagtgcagttgctccccgtgtatgccgaagaaaaaccgtatcgtaggctgcaatttcagccacttcaaaagcagtaggagtaccgcttatttgcagggttatggtgtcacccttttgaatatcgtattttgaggtaaaccgatccggcaaaataatttgattgccggaaaaatcagatatttcaccgccattttgcaggcgaggtttattgatctgccccaaagcatcaaggtcagcagcaattaaatccacggtttcatagtatccgctttcatggtatagggcagtaccttcaagcataccgacttttgcttttatgggtgataaatcgggaatgtcgctcaaactgatgtttccatctttcatttggacggaaacggttgcacttcccgccatacctcgagccatttttcgctgtgcactttcgtaggatactccgatggaaagggatacaaacagcaacattgtggatagaagaatggataagagcatgacagcggttcgtgcctttcgctcttttacataggttaaaatgtacttaaaaattattttcaaatttgcacctgctttctgtgagttatttctttaatgcgttttcgattgcctttaagacggtatcgcttgttagggtagcaccggatattgcatccacttccagtgactgtcccgaaagcaccttgcctgcaatctgttctgcttgctccatgtaagatggtttatgctccaaaacctcaatagcaattattttgtggtcttgcacatctaccttgaccacggcaaacaaaatcttattttgacagaacccaatatattcgccatctgaaacagtattcaaatcaaccgttccaatatcgagtggctgtggccgcaacagaaaagccacaaatgcaaacccgataaggagcgttattaccgcagtaagaatgatgggataaacctttctcaacttcattttctcacctccccaaacaatagaaaaaaggttggcagttatcatacttaaatgataagttgtcaaccttaaactatctttctctaaaccttaattaaccttaattcctgggaaagcacataagaaaagtggttccaacagtgggaacgctggaaacagaaatatttcccccatgtagctctataatattttttgcaatggcaagtcccaatccagtaccctccggcttttggtcagtgcttgcaccttgataatagcgttcaaataacttttctgtctctttttcggtcatgccttttccgttgtcgcttaatgtgatgtttatttcatgcacagaagtcgatatttgcatggtgatttcggtatctttatcaccatgcacaaaagcattcacaatcaaattctgaaatgctctaatcagaagtttctcatcaaaggaaaataaaattgtttcttccgtgctatcaaactcaatacagcggttttcatattctgggcgattgagtatatcaatggtcatttcccttaaaaagcgaacaaggttttgttcttgccgattgatgggaaccattccgctttcaagcctatatgtcagttttaaatcgtccatcaagttttccatgtaggcagcatttttcagcataatacctgcataccgtttgcattgctcatctgtcttaggcgtatcattcagtaaaatttcagaatatcccttaattggtgagagaggtgtttttaaatcatgcgtgatgtttgcaatccattctcgctgcatattctctgtttcttcccgaagtctatcacttgttctaatttccgtatctaaagaatttaagctgtcatacaaatccccaaaagttccgttatttttgcatggcagataggagcgttttgatatatctctcacggacatggccaagcggcttatcatttttgctgtcaaaaatccgtatgcaattccggcagcaagtatcacaagcaagagaatgcccacggtggaaaatacaatggtcttgccgcctgtaaatcgttctccgtttaaatacatggtgacttttctaatatccatcgggaactgtgtgatgtaagtatagtccgtttccccataggttactgtaccaacaaaagaagtgcttttctccgaattactatatccctttttggcaagttgcaaaagatctgaaatttcataatgggtaacgctatcttctgttgtttgaaaaccgtaaatctcattacctgcatcatctaatatttgcaatccaatttgattatcccgtagcagttcaagacctgcctgttttaattgtggcttatcatcaataaaaataatttgttcctttaggtcttctgtaaatgtactgggccaatcacttcttacggtttctccatttggtttcccaatggtaatcagcaacataaaaagaccaatcgcagcaaggattgtaccaagcagagataggaagaaaatgaggtaaatatgaaacactgtgcgataaccggatttcttcatttaattagtccttttctttagcttatatccaagtccttttaccgtaacaagttgtgttggactcgatggagtatcttcaattttttctcgaatatgccgaatatgaaccatgattgtgttgtcgcaaatactgctgtattcgccccaaacctgttcatacagccgttccttgctgataatcttattcgcattttccataaggtaggaaagcagaaaaaattcacgcccggttagttcaatttcctgtcctgccttataaatgcgagaactttccttatcaagtgtgagcgttcctacagtcaacaaatcattactatttgactgtgcggatgattgatactgttggcggcggagctgtgcctttattctaaagacgatttcacgtgggctaaatggctttgttacatagtcatcaccgccgcaggagagaccgagaattttatccacatcatcattttttgatgagaggaacagaacagagcaaagggagaactctcgtagttttttgcagacctcaataccgtctatatccggtagcataatatcaagcactactacatcgggtttaaactccctgcaagcctgtaatgcttccatgccggtatgtgctttttgaatgaactgaaagccatcttgccgcagagtttcctctaataaatctgcaatatctttttcatcgtcaacaagcaatattttaccgttcaatagtttcacctgctttccgttttgttcttccgtcaataggcttttcggcatccttaggaataagccacatatatcctatttttgaaatgtcgggaatacagctttctgcacagagtttttgcactcgtctttctgaaatcccccattttttaactgcctccggggctgatatataatccatttgccgaccatcctttttaactttttatctaattatatacggacacacgaataataacaacaaaattccagcaattatatgctctatcacagtcaatactatgtatgagtaatcatatccaaagcacatgggtgaatggtaaaatataatagggtgaaatattatgaaggaagcaaaagaaaagtttgattttaaggctttcggattggctataaaagaggcacgaaaggcaaagggatattcaaggaacgcattggcaaatgagctatgagcttgtcactcttttggatgtttcggtagacacattcttttttcccaataaggaaacagacaaatccacgcagcgcagacagcttgacagtctgctggatgaagtcagcgaccagggattacgaatagtcaccgccacggcaaaagagattaaggaagtcgaaacagagggcaaagcatgagcctgaacatacaactgaatatggcatgaggaacgctatgagcccatatggtttgtagcgtttttctattgaagatggtagccaaaccgttcctttggggattacctaaatacgagagaactaagaacagcaagcatagcaagcgagtacccgcttgctatttttcctgttttcaggtcccttgcccgaaaatgaaaaaggcttattgggagtttcccaaacccttataagaacggaggaacactttggcgaacagaaagagaaaaatccaaatgaaatttgtggtgacagccgaggaaaaagagctgataatggtgatttgccattacggtataatcacgggttttctctattcggaaaactgccatgtatggttgccaccataaaataatgaagggcgaaaagtcttaaaaataggcttttggcccttgctttatatataacagttacaaaaagatatttcaattgtaggcggtaaatccgcctgttattcggtcatgctagactacttcgaaagtcgcccctcatacagaaaaagttttacattctcgattttttcttgaattgacagtttcagattgtgatagaatttaaaatctctacggttatctcagaggcattgctgccggtagcattatcggcattttgcaggtttgtggcaaagcagtaaactcgtttgccgcgttcaagaaagccgataaaccacccatttgaactctgcccgttcactacccctgtgccagtttttccatataatcttccgatggcagtatcagaaataaataaagaattctttatcgcctgaacattctcttcttcaaaagcccatttgttttccagcagatttgataaaagcatcacttgttctactggagatatctttaaggaagattccgcccaataatagttaataccagcagtcagatcgcagtttccataagagatttttttataataggaatagagtttctgatatcctaactgtatatccaggttttgaaaataccagtttacggaattttgcatggcggttgcaagggtctgatctttattccatgtatcaaaggaataagtagttccatcccatttttgaccagaggcatcataatggatgatgtcttcctccaatgcaaagagtccgctatatattttaaacgtagaatcaggagagatgcgtttggtgctcaattcctgattgtatatctgatattgatcgctaactgtatcatataagacgaatgttccgtccgttcctttgaaataggaggacagatccatggcttctacattttgagactgaaaattataggacgcatcttgcgaagcgtatacggtcagcaaagggcttaggcaatagaccattgtgcaaatcaatagtaataatacggcacttttccgtctttgctttggagtattagatttatagctggcaatttccttgatccgctgaatcattaccttcttttctccgcccaaacgggatagaggggagagaaaggcattgtgcggcatcctctgggcatatctgattaatgtatagccataatttgtagattggctttttccaacaatatgaatcacggaattatcacaagcaatttcccgatctttttgcaatacccggaatccataccagataaatggattgaaccaatagataacttgcaggatacaggtaatgtaattcaatgcggcatctttatgcctataatgcagcagctcgtgcaagaaaatgaaccgtacatcttcatccgataaaagtatgtccatgtcttgcggaataataacccttggatggagcaggccataggataccgggctggatatattgcaggaagcatagagagaaaccttgcgcctgatacgaagtttattcaagcatttagaatactgtctatacaaatcgggttcattttcttccgatattaaatacgcagattttctgatggaataaatctttataatgtgatatgcaaaatataacgtggttatcaaacagcctatgatccatatagaaatgaagatgctgtttaactgactcagagcagaactgtcataggatgccgcaaaatcagatatacccagctgagcaggcaaagccgcaatatctaatggtttcacagaacttccaagcgtactagcagcctctgggtagaataaatattgtatcctttgaagcagtgaagcaggaggaatgcttttaagaggtataaagggaattatcgctgcacagacaaaaatataccataggtgatactggctgcttatagtaagatgctttttaaaaatctttttcaccgagaggatcaatcccagcaaaatagtaattacaagattacacaatagaaaatgtagtgcaaacatcagatttaatcaccaccattcaattttgaatcaagcaaatggtacatagttcttaaatcttgatcagataactgtgcgtttgatagcagcgatgacaatagcggggctgcctcgccatcataaaaacgcgttaaaaatgagcggttttcctgtgataaatatttgcttttcgatatgatcggaaagtagtaatacatgcgccctctttgttcataagaaataacatgttttgagactaagcgggataataaggtatgaaccgttttggaactccagttatgaacggcaggtacttttgcacagatatcattcgtgctgataggagaatcctcccatacaattttcatgatttcatattcagcttctgaaatttgaggtaatttttccatgatttctgctcctttaatcttacttatgtagtaattataaaagatagagttgtaaacgtcaagaattctattgacaaaaaagttgggaaaggaacataatattatatactacgattgtaagacttagatgggagactattatgaatacaaaaagaacaggaattatgctgttgattttattatccctgtctgggtgtgccgcgccggaacaggaggaaagcacttatattgccgaatcatctgatcataaggatgattttgggagtggggaagaacaagatgaaaatgaagattatgaactgaagaatatcaagatgaagccagaagaagtagaggaactgtcaaaatcggttttggaagtcgcagaaaaatgcaaggcagcttaccgcaaagcgggtaagaatgatgcatcggatattgcgcttcaagaagaaactgtacatcagatgatcgaagatgcggctaaaggcgggctgtcaatcacctgtggaggaaccgactacaacatgcagaattatgagaaagtggatcaggcgttaaataaggcgaaaaaagggaagaacgcagagacagaattttacgaaataaataacagtggaatcttaagatatatccggcttcaatttaaaaagcaaaagttgtatgtgacatctgtgagtgcgatactgaatgataatgcgaaagcccagatccagcaagtagaaaaaatacaggcgtatgactgggaatatacgcagaaaggatggctcatatgggaaaaagcgttgtcaaggaatcaagagatggatatgcatgtgttttatagagttctgccgttagacgcaaaatgcagggaacttggaaataaatgcattataccggtgagttacttttgcaataatttattcctgacagattgggatgtgaacagcatgggaaatctggaatttaatgatctgtatgaattcttataccagatgaaatatggggaaaagatggatgaagaattatatgagggaggcattcccaaaatagaatttgaagaggtggtacagtcattttttgatatttcaacagaacaattagaaacatttgcccgatacgataaagaaagaggcgtttatccttgggaaccaattaaatactggaatcacatttcgcaattccagccgtttccggaagttgtaaactatatagaaaatgaggatggatccttgactttgcgcgtagaagctgtttttacggaaggaggtaaggattgttcttttaaacacgaagtaacaataaaagagcaaggggagggctggatctatcttggaaatatgactgaaaaagacgaatcctacaggattttgcagtaccggccaaggagagcgttttacaataccaataaagagcggacagacttagaccaatagatttgcatagatatagtttaaaggacatgatatactataagcagtcagaatatgtcagattacggcttgcagaactcggggtgaggaaatctgcaagctttttatataaagaatagccaggaaaggacggccttaggatggagagagaaaaatcgtatgcggtatatctgaagcggggatgcattgcggtactgaaagtagaagtgttttttaaattgattgcctttttcgtgatagggccgcttttggactgggcttttactacttgggttctgggtgatattcctgtatttaacgaagcaatgtttttaagcattctttcacccgtcagcctggtgcttgcggtcataatattcctggctgttgcactgtggtgctattatgaaataagctgccttattactgcggtgtatcttggcagaatgagggaaaaactgagcctggaggatattttaaaaagttctaaggaggcgatgaagggaatgaggcatttttcccttccgctatcagccatatattttgtattattcttgcctttggtacatgcaggatatttgaactcccttgtccctaaagttgatattccaagatttgtagtgggcgaactgcagaggacaagcatgggaaatctggggatccgggcgatacaggcagggtacatcgtggtgtttcttatattgctcttagtaccatttgccatggttctaaagcgggagagtttcccaaaggccgtaaagcaaaactttatctggtaccgtcaattcagttggaaagatagatttctgctgtgggcaatttttatattctggatattactggagaactggattctggattctttacagggaaagctgatccaggaccaggactttaatctatctgtgctgaaatattttttgcggtcccatacctacagggtagggcttgcgtgctggattgttcttgctctgattcaatgtgtggcaatcgtgctggtgtttttatggatcacccgattgctggataaatataaagcgttgccttatttgccagaacaggcgggcgggaaagaaggattaaagaaaggcttgcctgcgaaggctggaaaagaaagacgtatagccagactatgcaagaaaatctggagttccagaagttctaaaaagatctgggccggcatgcttcttatagcaattgcagcagcggctacggattattttaacgaagcgcctttgatgcatgaaccatgggcaatcgggcatagaggatgcatatttgaagcggaaaatacgattgcggcagtggagagggcctcgggacttggggcggattatgcggaaattgatgtacagctttcaaaagacggtgtccctatggtgattcatgatgaagatttgcagagacttgcagatatgccggagaaggtagagaacctgacggcagatcaattacaggaactgacagttatttccaatggggaaaaggggaagataccaacgtttcaggaaatggttgaagcagtcaaaaatacgaaagacaagaccgggctgctggttgagctaaagcctacagcagagaatcgggatgaactcgtcagcaagataatagagactgtggaaaaatgtaatgcaaagaaccagtgcatctttatgtcgcttgattatgaaagcgtataccagttgcaggcggagcatcctgaatggtggataggctactgcatatatggaggcgtgggaaagatggaggatgctgtatgggaatataacattgatttcctggcagtggaagaaggactggcaagcaataagtttatggaaaaggctagaaacagcgggcttgcggtgtatatctggacctctaataactttgatgatatggaaaattatcttgagatgggggcatccgggattattaccgatcttccggatctggccagagatacgatagacagatacatgaaagaccatcaagaatactatgcgtatgatggaaagggatatccgaagaaaaagaattgaaaaattgttcagccaggtaagaaatacttgacagatctaaatgtaacctatattattacagtataaactgtaaccgtataagtaacagaaaggagcatgtcatatgaatacaaaagaacatgaagtgatgaaactgagaggaagtgcagatgtttcttacctggggaggaccgtggataagatgatatgggatttcatggaagaagaagggattaaaggcttgacgctcgcgattgtccaggcgccctatattccaagggttgtggggtatggatattcagatgaaaagcagaagcgcctggcttccgtgaatacgctgtggccggcaggccctatttcccaggggtatgcagccgtagcagttatgcagctttatgaggcgggaaaactggatttggacgatcatgccgggaaatggatacagaatgttccggaggaatggaaaaagattacggtgcgtcagcttctccatcacgcggcagggatccctgattacagaacaagggaagcctttgattcagagcgggagtggacgtttggggaactgcttgaactgatagaagatcagtctttggaattcgagcctggaacagaggtaaagcagagtgcgtcaaatttccttcttctgactgaaataattgaaagagtttcaggaactgcctatcaggaatatgtaaagaagcaccagtttgaacggctggggctttcacatacttcctttactggggatttaaaacagttcaaacaggaagatttgagtttaagcgaatatgttcatcagatctttaagaaagatgaaaggtatattgacccagcggagacagcagccagctatcgggatgatggcagcaaatatccggtgatcccctcttccgcgcttcggggatttggcgatgtgtgggcatctgcgcaggatatttccttttgggatatcgggctcgccgggggcgtgctgatacaggaacctcagaatcgcgcggtggtatatgcgccgtggaaactgccggatgggagaactgtaccggccagtgcgggatggcaattttataatcacaggggacttatggacatcaagggctcgatagcgggctactcctcatttttaagccgttttacgcatccggaggaattagtctgcgtgacattgatggcaaataaggagggcgtggattttaccaatctgggcaggaagatcgccggagcctttggggatctgctgtctacaaattatgatgatacccgcttgtatctgctggaagggcagttatccgttaaggagacggtgcagcgtcttgaaaagcaattgaatgcattggatattccggtatttgcgaaatttgatcatgcagaaaatgcaaaagaggcaggacttgaactgcgtcctaccacagtactggtattcggcgcgccaaaggtaggtacgattcttatgcaggctgaccaaagtattgcgcttcatcttccgcttaggattgctgtttgggaagatgaagcaggaagcacctggctggcctttccgaaaatgaagcctgtggcagaagaatatggacttggaagccatccgatcgtagaaaaaatgcaaaaactcttagaatcacttttaaagaaggcagcaaattattatgaactttcgttataaatagcgtcccattccttcctatggtacaatggatacaagacatagaatgtaccagccccgttcatgcggggctggagaaaaaggaggcatgggaatggacgcaaggctagaaccactatttacgccatggaagattggaaactgcgagattaagaatcgtatcgtcttgacctccatgggaggaacgaaccttctggggtggatggaaaagaaccattttgacaaggaaggggcacgcttcatcatggaggctgccaagaataatgcggggctggtattgccaggatgccagccggtgtacaatccgatgttcgggcaatggctatataagaacaagaagatgtacgaggatttgaaggcctggatgcctgagtttcacaagacaggggcaaaactattcgtccagctgacggccggatttggccggtcttttacgatcagcaagatgatggagagcctttacgccaacaagttcttaagggtggtctccaagccgttcatggatctggacaagatcacggctacggcaagcccttctccaaaccggtggtcagacaaggttccttcgagagagatgacggtggaggaaatccatgaatttgtggaggctttcgccaaatgcgcgaaactgctgcaggaggcgggcgtggacggcgttgagatccatgcggttcatgagggctatctgctggaccagtttactttgaagtatgtgaatcaccgcacggatgagtatggaggatcttttgaaaaccgctaccgctttgcggtggagatcgtgcaggctattaagaaggaatgtggaaaagaatttccggtatccttaaggtacagcgtccgctctatgacaaagggattccgggaaggcgcgctgccgggagaggactatgaggaggcaggaagggatatggcggaatccgaaaaggcggtgaagtatcttcaggatgcaggctacgatatgctcaattgcgataatggaacatacgatgcctggtattgggcgcatccgccaatctacatgccggagaattgtaatcttttggatgtggagcatatccggaagtttgtggatattccggttgtatgcgcagggcggatggatccgcttgcagcggcagaggcagtcgcagaaggcaggatcgacggcgcgggattcgcccggaggttcctcgctgatcaggcatgggtgaccaagctgatggaaggacgggaggaagatatccgtccctgtatcctgtgccacaacggatgctttaatatgtgccattacaaaggggtacccaatgaccaggaattatcggacagcctgcatctggcacgctgcgcggtaaatgccgagaccatgcagtgggataagcactatattaagaaagcgccgtcctctaagaaagtacatattatcggcggcggcattggcgggatggaggctgccagggttctgaagctaagaggccatgaaccggtcatccatgaaaagagcgatgtccttggcggtacatttataccggcaagcgcggaatcttacaaagacaagctgagggatctgcttgcctggtacaggcggcagatggaagtgcaaaatatcgaagtccatctgggcgaagcggtcagggacatggctcagtttggcagtgacccggtgatcgtcgcaacgggcgcggttccaaggattctgaaaaatgtgcccggccatgagcggatgatcgaggcctgcgagtacttaaacggagccaaagtcggagacgtggtggcggtgatcggcggaggcctgacgggaagcgagattgcctatgaactggcgctgaaaggaaagaagccggtgattgtggagatgaaggatgatctggtctcccagacgggcgtctgcctggcgaacagttcctatctgcgggaatggttcgctcttcatcaggttccggtctatctggaaaccacgcttaaggaagtaagggaagactctatcatctgcgccacgaaggaaggaaaagaagtggagattgcctgtgattcggtcatcagttctgcgggttatatatccaatcctctgcaaggaaatgggaaaggggtgcaactggtaggagactgtctgaaagtaggaaatctcaggtcagttatctggagcgcatacgaggcggcgatgaaggtctgatagggggcggagaacgatgatgaatgatagaatgaaactgtcaaaagagcaggaagcgatcctcaacggcagtcagggcgaggtgatggccaaggtgatggaaaccctggtccgctacggcgaattgttcggggcggacgggatggtgccgattaccagccagtataatcacctggtaacttctttcgggctgaaagcgctgggaccagtctatgacttgatggagaagctgatccatgccgggtgcgcgtcttcacagaaatttactgcggatccaaggccgatggataagaatgtgcctagttcttttctgcagaatatcgtattcaaccattttatgtacagcaagcaggagtactatgaaggccagctggagaaattaggcctggttgagaaagatgcgtttacctgtacctgctatatggacgaagtgggaaatacgcctaagcagggagacattctttcctggtcagaatcttccgcggtagtatacgcgaattccgtgctgggagccagatgcaacagaaattccgggattatcgatctgatgggctccgtcgtgggctacgtgccccatttcggacttctgaccgatgatgggcgcaaggccagatggattgttgagatcaggaccgccaaaaagccggaggcccagctccttggctctgccatcggcatgaaagtgatggaagatgtgccctatatcgtaggcctggataggtggcttggaacattggatgaagggaccaaggcctacctgaaggattttggagcggccacggcgtccaacggcgcggtagggctgtatcacgtggaaggaattacgccggaggccatacagcaggggcgggaacttcttgtggaagagccaaacgtatatatcattgacgatgcggaattgaagcgggtgtatgacagttatccggtgatctggaagaagaaggaggccaggccgaaactatgctttatgggctgtcctcatatgagcctggatcaattgacgcaatggacggagaagatcgagcagggactaaaggaagccgggaaggaacgggtggccattcccaccgtctttactgctgcgccggcagtccttaagaagtttgaggagacgccttacgcctccaggcttagaaaggcaggggtagttatctcctatatctgcccgctgatgtatatgaataacccgctcagtgccagcatgcctgtcattacgtcaagcaataagcttcggacttatacaagtgccaggtattatacggatgaggagattctggaacagattacgaagggagggagcgcgtcatgaagcgttttcagggaagagtcgttacgccgggaagtattaacgcaaaagccttggtatcccatgagggcctgaatacattggcctcttttcaaaaggcgctgcagtttggcgataagaaagccacctgcggagaccagaataatgcggacctatatggcaagcagatggcaggaagagcgctttgcctgccgaggacgatcggttccacgactggcgggctggtgctgtactgtgcctgctctatgaaacggcagcctgcctgcatgctgttctccgagcccattgattctctggccgcggcggggacgattcttgcggatgtgtggctttcggatgtgaagatgccggtgatcgactgcctgggcgaagagtttcttcaatatgtgaaggatgatatggctattgcggtcaaggacggtggaattgtggaggtggaggataagaacaatgtatgaactggtacaagcaaagggagacagctactatattcaaagtccagcgaagattggcgttttccgattgaatgagacggctgtatgcctgattgacagcggaaatgacaaggatgcaggcaggaaggtgcgccagattctggaaaggaatcactggactctggccgcaatctacaatacccattccaacgccgatcatatcggagggaataaatacctgcaaggccagagcggctgccggatatttgcgcctgggattgaatgtggatttaccaatcatacggtgcttgagcccgcctttttatatggcgggtttcctcctaaggatttaaggcataagtttctcatggcgcaggagtgcaaggccgaatatcttacgccggatacgcttccggatggaatgacagcgattcctcttcccggacatttttttgacatgatgggatttcgaaccaaggatgacgtggtatatcttgcagactgcctgtccagcagggagactctggaaaagtaccagatcagcttcctctatgatgtcagggcataccttgatacccttgacagggtaaaagagatggaggccgccatgtttgttccggcccacgcggaagcgacggaggatatcgcgcccctggcccaggcaaatattgacaaggtgcacgagattgcagagaagattctgtgtgtctgcaaggaggcgctgtgcttcgaggatatattgcagcggcttttcaatgatttctccttgtcaatgaattttgagcagtatgtactaatcggaagcacggtgcgttcttatctttcctggcttaaggatactggacggctggacgtggcttttgttcatgggaaactgctgtggaaagcgaattgaggaagggaaagcctgccgatctataaatatggagataaaagaagtccgctggcataattgccggcggattttccatttatagattttggctatatgtatattgaggaaatcaattaggaatagccagatggttatgataacatgataaggaataaaatcttaaggaatgaaatagatcgaatagattaagaggagagcaaagtcagacaagatgataggcatagaagaagtaatgcagaggatcagccttccggaagaggcaagaaaaaccgtacggcatatggatctgacgcaggttgcgtttgaagcgtggaggacgttgttctatgaagacatggaggaattccttgcgcgttggaatcagctgccggacaagcatgcgtgggcgctgggattctatatccgccttgcggccgaagtacatgacagatatcgcgagaagggaatagaagagtgcgtttatgaccagaccttctatgacattaccatctggtgcaaggaatgctatcggaagcacggcgtgtatgggctggaagaactttggtggctgggccagtccgtgaaaatgcagctctttcggctgggaaggctccagtttgagccgattgtcataaataagcccttacaaggaaagaatagaaccataccggcaggaacgcatgtcttgaatgtgcatatccctgcgggaactcccttgaattatgaggaatgcaaagaatcctttgcatggtccgtacgattctttgaaggaggatatgaggcatatatctgtgattcctggctgctgtcgcctcatcttaaggaaatgctgcctccggacagcaatatcataagatttcaggagaggttcgaagtcgtcaaggtacactacgattatccccaggcggagcagaggatatttggggaggtgctggaagataaggagagatatccggaagatacctcccttagaagagcggcaaaacagtatctgatgaagggaaacgatgtagggattggaattggtgttatagatgttccctataggaatatatagattatcaatttgtgtgcctttgcggtgtcatatataatgtcttatagacaaaagaatatataggagaggaagatcttatgaaaaagaaactgttaagcgtattattatgtgccgctatggttggctctcttgccgccggatgcggatcaaagaatgacaaaaaagatgcctcggacggggatggcaagacggtgcttacattctggtgccatgacaatgccccttgggtaaaggcttacaaagagatgggcaagaagttcgagaaagcaaatccggattacaaagtagaggtgcaggagtaccccttcgaagtctacaatgacaagattcagacagcattgacttccagcacgtccggccctgatatcatagcggtatggggaggcctggcgccttcattcatccagtcagacgccttgtccgaagtgccggaggatctttccaaggaattaaaagaagactatctggcgccgacggttggaatctatcagaaggaaggcaagtattatggcgttccgatggaattcaatctggaatatggcggtatgatcgttaataagaaactatttgacgatgcgggaatctcatatcctaagacctgggaagaccttcgcaaggtatctaaggaagtatccaggcaaaacggcgaggtcgtagagatgaagggcttcgagatgattgatacggatgcgctgatctgcaactatcttgcgatgatccttcagcagggaggccagtatctgcaagaagatgattccattaattttgccacgccggaaggcatcaaggcaatggaagagatcctgagcatggtgaaggacggcgaatgcgatctggacaacctgactgccggagaatattgctacaacgacgtctatcaggataagggctacatgtcttctgtcggctcctgggcgatcggcgagggaacagattcctatgatttgacatatggagaagacttcgaatatgtaccggttccgcagtatggcgagaagatggcatttgcatccgagacgggatggggaatcatggttccggataacggaaagaacaaagacgctgcctgggaatttgtcaagttcttcagcgagccggagaatctggtacagcacaatatcgcatgcaaccagcttccgccgagaaaatccttgctggacagcgaagagtataaggaggcaatgccgaatatcgcgttcctgctggatattcttcctagcggacagtggatgggaccttataatacctccgatatgcgtgagatcttcgaccagatgtttatcgggctttgccagtcagacaatccggatatcgaaggagcgttaaaggaagcgtctgagaagataacagaggaatgccagataggctattcgatggatgaatagataagaggcagggaattctttggggggattctctgcccctttcatatgacggaaggaaatgaaccaatgaaaaataatcgttttgtagctgcagtactgattcccggattcgtttttatgcttatctttgcagtctttccggtggcatacggcctggggatatcgttctacgactataatcctgccagcacgcacaatctgtttctgggaatagacaactataaaaggctgatccaggatgagacgttctggaaagcggtgcaaaacaccgtctttttctgtgtgattgccgtagttggaaatatagtgatcacgctgtttcttgcgaaaatcatctctgtgctgccatccaaaggattaaagactctttttcggacgatcctatttatcccatgtatcgcgccgatggtaggaacctctatggtatggaagtatggaatcgtaggcacggatggggggatgatcaatcaaattctggcattcttcggaagaagccccaagaactggtttctgactacgcttccgcttatgatcatcattatcgtttatacgctgtgggcggatatcggatataacgtggtgctatttacggcagggatcgagaacgtgccaaaagagttcgatgaggcggctgccatagacggcgcaggcccaatccgcagatttatctccatcaagctgcctctgatgggacgtacgtttgcgtttgtggctattatgacgatggccaactatttccagatgtttgcacagtttcgcatatttgcagccaagggcgggattgacaattctgcgatggtgcttacgaactatatctttaagaccagtttcctaagttttgatatgggatacgcctctgcgattgcaaccgcgttattcctgatcgtattcgtagtcgccctggtacagaataagatgatgcgatcagattggagttatgaatgatgaagagaagcaagaacgtatataaaaggtatcattacctgattatcgcatttatgggcgtgttttctgtgatcatgatgtaccccatggcatggatgctggtgacttcctttaaaagcaatgcggacatccataagaataaggcgaaattctttccggcagagtggacggtagaaggctaccgcagcgcttttgaaaaggcgccgattggagactggcttgtcaacagcatcgtaataacagctgtgattacctttgccgtaatccttaccagcacattgattggatatgtgtttgcaaaatacgagtttaagtttaaaagatccctgtttcttctgatgctggcgaccatgatggttccgccccaggtgacgatgatacccagatacctgatgatccagaagatgcatctgttcaacacaagatgggcgctgatcgtgcccgggcttgtaagcgcgtttgccatctatctggccaggcagtttatcacggatgtgccggacagcctgtgcgaggcggctaagatggacggagcagggccgcttagaatctattggagcgtgatcctgccgaatatcaagccggcgatcggctcgatcggaatctttactgccatggcaaactggaatgattatctgaatccgctcctgatgctcaacgatattgataagatgacgcttccgcttggcctggtgatgtttgacagccagcgttcggtggatctggcggcgaccatggcagcggctgccatgatcatgatgccgatgattcttatattcgtcttgttccaaagacaatttatcaagggaatgaccatgagcggcataaaataaagcacgtgcgaatagtaaatgagagggaaatcagaatgaagaaaaatacagagatacattatgaaatgaagctgctaagctcgcttgcgaaggtatttccggatgagacgcctgtatacaggccggaatgcctgcttctaagcgcgctgtggggagagacggtatcctttcaggccgcgtataccggggatttttttatgcgggaacgcctggacgtgaagattacatcaccgctggagaaatggatcagggtaaggagcgtggagcaggttccggtgggacgggccaccaatggaattgtggatgacaattatctaaggacaacctcgggactgtatccggatctattaagggacttaaaggacaaaaaagcaatcgtgtgctccaaccaatggcgaagcctgtggattgacgtggaggtaacagaagagattgcgcccggagagtacgcaatcgaagtcagcctgcaaaaagagggccatgcagtatgctcctgcgtcatgaagattaccatcatcggcgccagcctgccacagcagaagatcatacataccgaatggatgcatgcggattgcctggcagattattaccaggttgacgtattttcggaagaacactgggagatccttgagaattatttccgccagtatgtgaaaagaggctgtaatatgatgcttacgccgcttttcacctctcctctggatacggcgataggactggaaagaaccacgacccagctgatcgacgtggaagtaaaggacggggaatacctgtttggctttgataagcttaagcgatgggtggatctgtgcaagaaatgcaggatcaagtattttgagatgtcccatctgttctcccagtggggagcaaagtacgcgccaaaagtcgtggcaatgcgcgacgggaaggaagagaagatattcgggtggcatacgcctgcggtgggagagtataccagattcctccaatgcttccttccgcagctgattgagaagttacgggaatgggagatcgcggacgtcacatatttccacatctcagacgagccaagggaagaagatcttaatacctaccgggctgccagggaatctctgggaaatctgctggatggattccagacgtttgacgcattgtcgagttatgaattctaccgtcacggcctggttgaaaagcccatacccggcaataatgagattgaggaattcctggagcatgggcttacggacatgtggacctactattgcaccggacagtactatgaagtaagcaaccggttcatgtccatgccatctgcaagaaaccgtatctatggggtgcaattgtataagtacgatattgttggaatcctgcactggggatacaacttctataacagccaattttccatcgagcacatcaatccctatgaagtgacggatgcaggcaacgcgtttccggcgggagatccattcctggtgtacccgggggcggatgggcatccggaggagtccatccgaatgatggtgcatgatgaggcaatggcggatctgagggcgcttgaactattagaatccctgaccagcaaggcgcatgtgatggaactgatcgaaggagagctatttgaaccccttactttttgcacctatcccaaatcagagatgtacctgattacgttaagaaacaggatcaaccgcgagattggcagataccagtcggaaggatgtgtaagaaaatgagcaagacaaggatcgtaaaaacaacctgctccacctgcggcccgtgctgcgaagtagacgcctatgtagaaggcggaaaactggtaggcgtggaaggcgccagaaatacgccggcccagtcaggaggcctgtgcgcgaaaggggcggcagcgctccagtatgtctataacaaagaaagaatcctctaccctatgagacgggcaggggaaaaaggagaggggaaatttgagcggatctcctgggatgaagcttatgagatgatcgcagagaacctgcttcgaatccgcgagtcttatggagccagatctaccgttttctatgcaggctatcccaagtggttccgtccggcgctgctgcggatggccaatgcctacgggtcgccgaacttctgtaccgagtccagcacctgcttccaggctgcggcgcttgcctggcgctccatatatggcaatggaatctgcgggccggatatgcccaatgtcaagacgctgatgctatggagttccaacctttatcattccaatacgcccatgagcggcatgtataaaagcttgaaaaagaggggcgtcaagataatcaatgtggatccgaggcatacggtgaccgcccatgacgctgatattcatctgcagctgatccctggcacggatggggcgctggctctgtctatggcgcaggtgattatagaggaagatttgtatgacaaggagtttgtagagcagtatgtctacggatttgatgaatataaagcatatgtacaggattttacgccggagaaggcggagaagattacaggagtccccaaagacatgatacgtctggcggccagaacctatgcaggcgaaggcccggccggaatcatgttctcggcatctccggtggtccatcatttgaatggagtacagaattaccgggccgtattctcattgatcgccattaccggaaactatgatgtgaaagggggcaatcggcagcgtcccgccccttcctgcccggtaaatgagtttgggaaagtccggcgctatgatcaggaagaagccatcggacagaaggaatttccggcctggtttgacctgtcctgcgacgaggcgcagtgcaccaggctggcagactacatacttgaggaagacccttacccgattaaggctgtatttgccatgggactgaaccaccgtatgtggccgcagccgcagaggctgaatgaagcgctcgggaagctggacttctatgtaaatgtggaattattcatgtccgagtcaagcaagatggcggatctggtacttccggcatgcacttcctatgagagggaagaggtgcatgtcctaagaggcggaagattcttcttctccaaccaggcgatccagccgctgggcgaatcaaagaacgatattgagattattatgggagtaatgaagaagatgggccttaaggacgaagtgcttgtacaaggatatgattcttacatggagcatatccttaagcctgcggggattacactggaagaattaaaaagccatccggagggcatgcaagggaagaatctggttcctccggcagaaaagacttatgagacacagcctttttacacaccctctggaaaagtagagttaaaatccctggtgcttgagaaatacaaggcaagccatggctatgacggcttgccggtttaccatgactaccgcatagaaaccagcattgaccgggaggactatccacttatcttgaatacgggcagccggaagccgcagcttttccatgccaggctataccgtatgccatggctggcaggcattgagaaggagccgctggtagagatccatccggaagatggcaaacgctatggcatagcggatggcagtccggtaaggctgattactccggctggggaggcgaagggaattgcagcctacgatatagccgggcagccgggtatagcctacatctatcacggaagttccaagggagacgccaatgagctgatcggaaaggattatctggatccaatatcaggatttccgggatttaaaggctatttttgcaggatagaggcggtgaaggaggaagagtgccagtatgataaagtttaatgaagatctatgtattgggtgctatgcctgctacgtggcatgtatagccgaacataaccctcccgaggcagagaatgcgtatagttttcgcagcatcaaaaagacgctgtctgaggatgcaaagatgcagaaaaacgtctgcgacggatgcagccactgcgggaaatgcttggaagcctgtccgtttggagcgatatataaagatgagcagtatgggctgatactgacggatcgggataaatgcaggaagtgcaggaagtgccaggaagtctgtccaaatggcgccattcgcttcgatgcggatggcaggatggaaaaatgcgacggatgcatcgatcggcttaaggaaggcagagagcctgcatgcgtaagagcgtgccatgtaaaggccatacaatggcagtaataaagaagaaggatcgtatcatggagaaagagattgcaggatatatattggcaggcggcgataaccgaaggatggcaggcaggaaaaaagccttgcttacctaccagaatcagacattctatgctcacatcagggaacgcatgcctgctttcaagaatgtctacctgtcggtggaacaggcagccccttatgaggcattggatgcagatctggtcattgaccaatatgcagacatgggtcctttgggcggaatcttaagcggcctggaaaaatgcggcgaggatgccttgctggtagtgccctgcgacatgattccgtttccaggcgacatggctttgtggatggcagagcaatatagaaagacggggcgaccggtaattccatgcgagaaaggaagaaacttatcatttccgggaatctatacgaaggaaatgtggccggcattaaagcagatggaagaagcgaaggattaccggataaggaaggtgtgggagtcgttacggattccttacgagaaggtacctgtggaggatcatggctggaagattgccaacattaattctgaggaggattatagccttcttaccggcgcgaagatcaatatctccctggaggaggctctaaagatattagaacagcacattacaaggatcacggacacccagatgaccggattgatagaggcagttggacgtcggacggcgcaggacttgtattcccccatcgatcagccgccttttgcaagatctcctctggatggatatgcgttgcggggagaggacgttaaaggcgcgtcgcctgagaatccggcagaactgaatgttgtagacgagatttttgccggaagctattcgctacgaaggatagggccgaaagaagcagtgcggatcatgaccggagcccctattccggaaggggcagatgcagtgatccgccaggaagatacggattatggagaagaaaaggtacatatctttaaaccggtaaatccatatgataactattgcttccagggagaggattacaaggccggcgcctgcctggtgcataagggcgagcggatggatgcggctaataccgcccttgctgccagcatgggatacgacagcgtagccgtgtttcgcgagccgaggatcgcgatcatagccaccggagacgaacttcggatgccgggagaggatctggaggcaggccagatctatacatccaaccaattccttcttgccgggcggcttaaagaattaggaatcacgcagctgacggtcagaaaggcgccggatgctccggccaaggtcgcagcctgcatcaaggaactggcaggaagccatgatcttattattacgtccggcggagtatcggtgggaaagaaagacatcatgcatgatgtggcagagaatctgggctgccggaaactgttctggaggatccgctttaagccgggctctccggctatggcgttcatgtatgacagcacctgcgtgctgtgtctgtcaggaaacccttttggggcaggggcagggatggaacttctggtccgtccggccttgtcttatctaacgggagatgcagggtttctggcgaaggaagaaagtgctgtaatgtcagaagattttccaaaacccagcaagatgcgaagattcctgcgggcagtattaacgggagaggaggtccggctttcaaaaggccttgcttcctcgggggtcttaagcaccttaaaagactgtaactgtataatcgacatcccggcaggaagtccgggacttaagagaggtgaggaagtatgcgtgaggattctgtaaaagacgataggcagctgatatttgcgataagcggatataagaattccgggaaaacgacactgatcgaaaacctgatccctattctcacggaatatggatataaagtggcgactattaagcatgatgcccatgactttgagccggatgtgccaggtacggatacgtatcggcatagaaaggcaggagccttgggtacggccatattctcaggccacagatggaggattgaaagggatgccaaagaaaagatcagcgtgaaagagttgataaaggccttccctgacgcggatattgtattattagaagggtttaaaaatagcgagtatcccaaatatgtctgcagctgccctgaggaaaatgcagacgcgtcaaagatcgcggaggtcatcctggatatgataaatagcaaatagtaagaaacaggcagcgctgccacatgaaagcgttctgcctgtttcttattatttgagataatcaagaaatgcgcctaattcaattggacggctgtaataatacccctgataaatcgtacagcctagcgaaaggagcatatcccgctgctctttcgtctctacaaattctgctaccgtacggcagttcaggctattggacatgcgaaggatgctggagatgatatccttggaacgctcattgccgggcagctgggtgaccaggctgccgtccagttttacttcgcagtaggtattttcctggagctggaggatggaattatggcccatcccgaaatcatccaggctgaattcgattcccaggtttttcaggcgctccatccccttatccagggcgtcggacatttccattgcagcccgctcggtgatctcaagaatcagatggatatgccgcagttcatattgattcaggatatccgttaccctgtcaaagtattcgctatccagcatctcctttggagagacgttgacggacagatggatgtcgtcttttaagcacgaatccatcaactgcgcatccttacaggccctgttcagaagatagtagctgagttcattgaggaagccatcttcatatgccagggcgatcgccaggggaggagcaatatagccggcaaccggatgcttccagcgcatcagcgcttcagccccatgcagcgtatcctgcgcggtaatctgaggctggtagaataactgtatctgcccgcgccgcatggcgttatgcagatccatggcaagggtcttggcgtaatggctggtggaagattcccggtttaaaaagcgcgggatatgcccattcttttctccagctgccatatccctttccatctgccagatggcctccttaaacaggctggtctcttttaactccccacgccggataaaaggcatgtagatcagcacgccgacaaagatgttgaaaatctgcaaaaggctgcccgcaacggagccggtagctttataaccgctgacaatgatggggacggtccagtccaccgactgggtgaccactggcacaagtcctgtccaagtggcaaacgtgctgattaaagtcagtacgaccggagccaggataaatggaacgagcatagtaaaattaaaaataataggaaatccaaatacagcgatctcgctgatattaaataaagcggaaggcaatgccacgtaggcaatcttgcggttgtggctttttttggaagcaaggcacagcgcgatgacgaaactcaatgcgcagccgcagccgcccaggaatacaaaagtatccaaaaatgtctttgagaatatttccgtgggaatcttgccggaatttacaagcgcctgattaatatctatgttgtgctcgaataggctgcgagatacagcttccagcgtattggttccatgaatgccaagaaaccagagggcatgggtaaggatcacatagagcaggatgccgaaaatattaccgctgattccgtcgaaaagtctcaggaacagataggagccaaagtttacgatattatttccgccgccccaaaggcgtagaaggtagccaatcaccgcaaagaatacgataacggcgattacaggaaaaaggctctgtatggaaatattgaacaggtactccgcgccagtcgtatgcagcctttcaaaacggcttccgatacgcagggaatactgaaacagtatgcaggagagcagagtgatgcacatagcggtaaacacccattctgcgtcaaagatatagtccggctgatccattatgccgccgcagaaggccagataagagcttatagcgaccagagggtacagcatgaacgtgtccgtctcggcgaggaggccataggacaggctgatggttataataagcaccagggcaagagagccaaggctgatggagtataccgtagttaaaatatcggtcaaagcgccattcatccatgcttccagataacgctggtatgtatcgcttggaaagttaagaaagagcagggcaaaggaacccataataagaaatgggattgcaagcgtcagcccgcgccgtatagactgggcataaatagatttttgaaaacggctgatgtagttatggggattcatgactgctccttataataagaagaattcttttatttcattatatcctttgtttttcagttgcacaacatgtttcttagtttattgagttttaaggccaaatccgatataatggaactaataattgctggccaggcggaaaagaggcaaaagatgaaaaaagagaatcttgctacggttctggactcattgtcagaactgtatatttatattatcgaacaggaaactcatagattgctgtattttaatcagcgcgtgaaagaggctagcccggatgtaaaagtcggagcatgctgtagcgagttatggcatgaaaactgcgaggattgtcctttgctgagtatgggagatcaggattatagccatgtcatccattataacacgccttttggcagggtggtggacatcattgccaataagacggtgtgggatggaatacccgcttatgtgatcacgattacgccccataaattaaactttgaagagactcatgcgatagaagagattgaaaacatgtactctaagagcctggttactgtttttaaggaatgtattattgcaaacttgtctcaggactattatgtaaactgccaaagcgatatgcaatggacgaatattcccaagcagggacagtttggaagggagaatcgtatctacgccagcaagacgatccacccggatgacttggagcttttcaatgcctttttttcaagagaggcaatgctgcggctattcacagaagaaaataagagacagatatccaaaaaaatgaggcgcatggtagatgacggaacttaccacatggtagaattcactgccacgcgcattgaagataaacaggaagattgctggtgcgtcctggtatttacggacatccatgaagaataccttcatgagatggagcgaaacgtagagatgagccagctggccactgccgcgaaggaagcctacgagatgctgatcgcagcgaatctgacgaagaattcatactatatgatggagtatgaccggttcaagaccaaaaaggcgccggaggcaggaaattttgacgacttgatacaggttggcgcgtctaccatggatccggattacaggcagccgtttctggatagattctccaggccgtcgattctggaggcgtttgaaagaggcgagcggcatattgtcatggaggtccgccagctaggcgatgatggggaatatcactggaattccgtacaagtagtccgggtggaaagtccttatacggatgatatccttgaaattacgctgactaagaatattgatgaggaaagaaggcagcaggaagaatatctggagaaagagcgggcggcaaagaaacttctgaaagaagccttgcagaaggcaaaagcggcaagcgaggcgaaaagcgatttcctttctaagatgagccatgatatccgaaccccgctgaacgcgatcatgggcatgacgacgcttgcaaaggcgcacattgcggagccggagaagatcgaagggtaccttaagaacattgaagcatccagctcgcacctgctgggactgatcaacgacgtgctggatgtaagccggattgaaagcggaaagacggagcctcaggaacaggaatttgaactggaagatatggttgaaagcgtgacagccatgcttaggacggttttgggaaaaaggcggcagcagttgtccgtggagattgaagatgggattcatatgtcggtggtaggagaccagcagagaatccgccagatactcgtcaatctgctggataatgcgtccaaatatacaaaagaaggcggaagcatccggctgtccctggaggaattaaagaaggatcagagggatgtggggacttaccagtttacggtggaagataatggtattggaatatgtccggaagatattgcacgtatcttcgagcctttctgcagagtcgccgacagcaggatcagcaaggagcctggaacaggacttggacttacgatcgtccagaacctggtccagatgatgaatggggagatacgggtggcaagcgagcctggcaaaggcagccgatttaccgtgatcctttacctgacaaaaagcagcgggaagcataaggcacagacttcggtaaagatcgagccggatgaagcatttgcgggcatgaaggtcctgctggtagatgacaatgagttgaaccaggtgatcgcgaaggagatgctggagatgctgggagccgatgtagaagtggcagtaaatggacagcaggccgtcgagatgatcgagaggaatccggagttttattatgaactggtatttatggatatacagatgccggacatggatggctatgaggcgacgagacgaatccgaaggctcggcaaggaagggattgacgaactgccgattatcgccctgacggcggatgcattcttggaggatgtaaagaaatgccagaaggctgggatgaacggccatatatccaagccagtttctttggacaaatttaaggaaattctaagttatggaattcactgggaagagaagaataagcgaaaaaagcggcagccggtataaatgtgccgagggatcagccggattttcgcacatttttggacagaagtgatattgcaattgattcctgcattctatataatagaaaaagttttaaatggcaaagaccctgatgactgtcggggtcttttacacgttcgggcaggaggcagagagatgaacaaggaaatgacagcgggaaagccgggaaaaatgatactgaattttacgattcctatttttatcggaaatatattccagcagctctacagcatggcagatacggtgatcgtaggaaaattcgtagggaatgaggctctggcagccgtgggcgcatgcgggacgctgatgttcctgatcatcggattcctgcttggccttacagccggatttacggtgataacggcgcagcactatggggcggggaacctgcaggccatgcgccagtccgtggcatcgggggcgattctgtctgcggcggtatccctgattcttaccattctcagtatggcgatgatgaaggacatcctgcgctggatgcatacgccagcggatatgtatggccaggcatatgggtatattatggtcatctgcggcggaattgccgcccagacattatataaccttctggccagcatcctaagggctcttggggacagccggcgccctttgtatttcttgatcctggcagcgcttttaaacatcgtgctggaccttttgctcattatcaagttccggatgggcgcagccggagcggcatatgcgaccgtcatatcccagggcgtatccgggcttttgtgcctgctctacattatacggaaggttcctgaactgcatcttggaaaagaagactggaagatgaactgggatcttgcaaagtggcagatgaagattggatttcctatggctttccagttctccataacggcaatcggaaccattgtggtccagtctgccctgaatatgctgggatcggtagctgttgccggattctcggctgccagcaagatcgagcaggtggttacccaggcttatgtggcccttgggaccgccatggcgacctattgtgcccagaacgtaggagcaggccggattgaccgtatacgcaagggattccgaagcgctgcctggatgggtgccgtctatgccgtggccacaggaatcctgatcttcttctttgggaaatatatgacagctctgtttgtatcccataatgtgggcaggatcatggaatatgtggatatctatctgaagtgcgttggcatctcctttatcccgctggccgttgtcaacctgtatcggaatgggatacaggggatgggatacggccttcttccgatgacagcgggcattgcggaactgatagggagaagcggggcggcccttgcagcctcccattttggcagctatgcaggcatctgcctggcaagcccggctgcctgggtcctggctggaacgcttctgatctggatgtatgcccggataatgaagcagtataaattaaagggaatgctaaagtagcatattccctttttcaaattcctatgctatactttactgtaagtatgcgaaggcataaagataacagaagtaaggagcttaaacttatgaaaagagtactattaaaactcagcggagaagctctcgcgggggagaagaagaccggatttgacgaggccacctgcatgggagtcgccagacaagtgaagcagctggtggatgatggaatccaggtagcgatcgtaacaggaggaggaaacttctggagagggcgtaccagcgagaccattgaccgtgtaaaggcggatcagatcggaatgcttgccacagtcatgaactgtatctatgtatctgatattttccgctatgcggggatgaagacagaggtatttacgcctttcgtatgtggcgcgtttaccaccttgttctcgaaagatgcggctgtggaggctttaaatgaaggaaaggtcatcttttttgcaggagggaccgggcatccttatttttctaccgatacaggagctgtgctccgcgccatcgagattgaggcggatgcgatgctgcttgcgaaagccattgatgggatctatgacagcgatccgaaggtaaatccgcaggcgaagaaatatgacgaaatatcgatccaggagatcatagataagaaactgatggcggttgaccttacggcatccatcatgtgcctggagaacaagatgcctatgcttgtattcgggctgaacgaagagaacagtattgtggagacgatgacaggaacctttacaggaacgaaagtaactgtatcataataagagaggagaagtaattatgaatgagagactacaggtatatgaagacaagatgaagaagacgatggcaagccttgaaagcgaccttgcaacaatccgtgcgggacgcgccaatcccaacgtactgaataagattatggtagattattacgggactccgactccgatccagcaggtgggcaacgtatccgtgccggagccgcgcatgattcttatccagccatgggagaaatcgatggtaaaggcaatcgagaaggccatccagacttccgagctgggcatcaatccgaccaacgatggatccgccatccggctcgtgttcccggaactgacggaagaacgaagaaaagaactggtaaaggatgttaagaagaagggcgagggcgccaaagtggcaatccgcaatatccgccgtgacggcaacgatgcgttgaagaagctgaaaggatcagaagtgtccgaggatgagatcaaggatatggaagaggaactccagaaagtaacggacaagttcgtcaaaaaagtagacgaggcagtggaggccaaatccaaagaagtaatgacggtttaatgaggatggggacaggcccaaagtacactggggcctgtccccccattcatggaaggagatcagccaaatgaatataccgcagcatgttgcgattatattagatggaaatgggcgctgggccaagtcaaagggaatgccccgcaattacggccacgctcagggaagcaagaatgtggagcgcatctgcgaggatgcataccggatgggagtaaagtatcttacggtatatgcgttttccacggagaactggagccgtccgcaggatgaagtggacgcgcttatgaaacttctcagaaattatatgaagacctgcctaaagaccgctgcgaaaaatgatatgaaggtacgggtgcttggggacatcagccgtctggatgaggatatccgcaccaggatccaggaacttaccgaggccacgaaggataatggcgggcttaatttccagatagccatcaactatggaagcagggatgagattttaagggccgtcagaaggctggcggaagactgcgtggaaggaaggcttgctccggcacagattgatgaggcggttttcgaaagttatctggatacccatgatatacccgacccggatctgctgattcgcaccagcggggaactgaggctatccaattatctgctgtggcagctggcatatacggaattctattttaccgatgttccgtggccagactttacgaaggaagaactggcaaaggcgatcgagcattacaatgccagggaccggcggtatggaggagtaaaggaggaacagaaagaagatgtttaagacaaggctgttaagcggcatcgtactggtgatcgtactgatcgttacggtcggctatggaggcaatctgctgtttgcctttttgggaatcatcagcctgatcgggcttacggagttatacaaggttgtagaagtgcagaagaaagcgctgggaactgcaggctatttggcggcaatcgtttattatgggctgctgcttacagggcatatggaatatatgacaatgctctccatcctgttcctgatcctggtgatggcagtctatgtatttacctttcccgcataccgggcagagcaggtcatgacggtgttctttggattcttctatgtggcagtcatgctttccttcgtgtaccagaccaggatgctggctgacggaggcgtagtcgtatggctgatctttttgagttcctggggatgcgatacctgtgcttactgcgtgggaatgctgattggcaagcacaagatggcgccgagactaagccctaagaaatcggtggaaggcggaatcggcggggtggcaggcgctgctcttttgggcgtattgttcgcgcttgctatgaaccaatggggaggcgcgcaggccaatccgcttcattatgcgatcatctgcgccgcaggaggcatgatatcccaagtgggcgatctggcggcttctgcaattaagcgcaaccacgacattaaagattatggcaagctgatccctggccacggaggaatccttgaccggtttgacagcgttatatttacggcgcctgtcatctattacctggcggcgctgcttgccggaaatatttgatactgacagagaaagtattgccatataatatctaagagaggtaatttatgaaaagaatagccatattaggatccaccggctccataggaacccagacgcttgaggtggtcagggaaaatggggatattgaagtcctggggctggcggcaggaagcaacatcactcttttggaggagcagatcagacaatttcatccaagactggcggccgtatggtccgaggagaaagccagagagctgcggacgcgtattgccgacacggatacgaaggtcgtatccgggatggatggactgattgaagtatcaatccttaaggatacggagatactagtgacagccatagtggggatgataggcattcggcctaccattgaggcgatcaaggcggggaaagatattgcgcttgccaacaaggagacgctggttacggcaggacatattatcatgccgctggccgccgaaaagaacgtatccatccttccggtggacagcgagcacagcgcgatcttccagtccttgcagggaaatgagcacaaggccatacacaagattcttctgacagcttccggagggcctttcagaggaaagacggaagaggaactgctggatatcaaggtggaggatgccttgaagcatcccaactggtccatggggcagaagattaccatagattcctctaccatggtgaataaagggctggaagtcattgaggcaaagtggctgtttcaggtggatgtggatcaggtacaggtgatcgtgcagccccagagcatcattcattctatggttgaatatgtagatggcgcgatcatggcagaactcgggacgccggatatgaaacttccaatccagtatgcgctctactatccgcagcggcgttatcttccaggcgagcggcttgatttttatagccttgggaggctggaattcgagaagcccgatatgcgtaccttctatgggctggctcttgcctacgaggccggaagggccggaggaacactgcctacggtatttaatgctgcaaatgaattggcagtcagccagtttttaaaccgtcagataaagtatctggagatcatggaaatcatcgaggactgtatgcaggcccataaaaacatagagaatccaacccttcagcagattttggatacggaagcggcaacttatgaaagaatcaacagcaggaggtagtttacaacttgggtattatattagcaatattgatctttagcttcatcgtgttttttcacgaactggggcattttgtacttgcgaagaagaatgggatagacgttgaggaattcgcgatcggcatgggaccgctgctgtattcccgggaatacaaagggacgaaatacgctgtcaggctactgccgatcgggggattctgcgcgatgggagaagatgaggaggcgacagactctccgaacaacttcaacaataaatctgtctgggcaaggatctctgtcatagcggcaggacccatctttaacttcatactggccctggtatttgctgttatactgaccggaatgatcggatacgacaagcccgtgatcggcgaggtagagcagggatatcccgcggcggaggcggggatcaaagaaggggataccatcgtaagaatgggagataagaagatcaacgtattccgggagatcaatacttataaccagttccatcaaggagagaagacgaagataacatttatccaggatggagagacaaagacagccaccctgacgccgaagatggatgaagaactgaactattaccggttcggcatatcctccagcggctataccaaagcgggggttctaagcgcattgcaatatggtgcctatgaggtaaagtactggatatgtacgacgcttgaaagcctgaagatgcttctgaccgggaagatcgggctcaaccagctctcaggcccggtgggaattgtagatgtggtagatgatacctacaaggcaagcaaatcttatggagggttcgcggtgagcgtccagctcctgaatatcgcgattcttctgtcagccaacctgggggttatgaatcttctgccattgccggctctggatggaggaaggcttgtcttcctgtttgtagaagccgtgcgccgcaaacgtattcctccggagaaggaaggatatgtgcatctggtagggatcgccctcctgatggtgctgatggtgtttgtcatgtacaatgatatcagaagagtcttcttctgatgaaatcaataagaagccggatgccggaaaagacagtgaggcaagactttctgtcttttccggcatccggcttcttttatatggcttactgtagttcggcaatgcgggatacgcctacatagacctcggatattttgtaccaggtcctgtaatccacggttccggtctggggcaggccaaatatagattgaaacctttccacggaagcggcagtcgcaggcccgtagatgccatcggcgtcgactctgggaagggcgggataggcgccggcgatgacattcagctgttcctgcatctgccgcaccttgctgccggaagatccgatttccagcgtatagccgggccaggacgatggaatgccggagatggcttccgccgtattgatgtacatatcgtccccataatagtagcgtaggatttcaatggcagaataaccctgatcgcccagagccttcgagccccactgcgtcatccagttgggacactgcacctgcctgccgtcgcagtactgggtgaggattggctgacggacattgggacgggagagatagtccgcaaataattcgtctacaatgacggatatggtgtcgaagatgttgcgctccggaatccacttgtggtcaaacgcggtggaggaggttatggtgaaatcatagccctggttgcgataccattccgtatagacccggttcagggtgaaggacataatcgccaggatatttgcgcgtatggtattagttggccaggtggcatagatctcgctggaggccacattcttaatataatccttatatctgacatagtagttgctggcagtggtatccctggggcttccgtcatggacgacgataaactccggtacgacgacgcggctcaggacgatctcgccggtctcggttactggctttatctcgtcttcgggtattttaggagggtaagttccatataatgtatgtgcaggtatgacgaatatccgttcagagggctgaggcgagtccatgggcttcagagtcaggttctggacggcagttaccgtaggaagtatctcggcgccggcaatgctgacaggctcatatcccggagcctctatctgaagcgtatattcagaatagggctgttcctcgatcgcggggttcagactgtaatccaaaggcggggcagcaagctcgatcgtctctgtctgtccggaagagtcggtggtcagctgttccagctggctgtcagggactccggtataggagatagagacggtagcgtcagccacaggactggcggtgacatcagatgtaatattaatctgcagccgccctttatcaggagtgtctggctgggttggatttacgacattcatataagtacctcatagagactctattactgttatcatatgaaataagggagaaaaagttactctattgtacaatcaggccaaagcgaatataatgtttttaatgaatcggcggatacgccggcaagacggatgcaggaaggcaataaagagcatataaggagcatatatgggaagaaggaagaaaaagggatatctacatatcgtgacgtggggaatggcggttctttgcctctttctcgtggccgcctgcgctgcctgtatcggcaaggacgtgcagaaaggaatcgagaagggcctaaaggagaaggggagcattccctaccaggaagtgggcatatcggatgacgagctgagtcagaaatattattaccagcaattagaagatggagagaagcaggcgtataaagagattgtccagggagtgaaggagaatgtagaggagatctatgtccatgcatccgatgcggacaggacgaatatgctgtttcagtacgtattgaaagatttcccggagatattctggtgcgacgggatgactacttcgacttcttatgagggaagcgaggcctatacggttcttaagccggtctacctgtatgatgcagggcagaaggaggcaatgaaggccaagatcgaagcttcggtgaatgaatgtctggcatccatgcctgcgaaagatacggattaccagaagatcctatatgtctacgaatatattgtaaatacggtggattatgaccttgaggcagcagacaatcaaaacatatacagcgtatttgtcaaccgccgttccgtatgcgcgggatattccaaggctacccagtatctgctggaaaggctgggcgtgttctgcgcttatgtgacaggaactaccttggatggccagagccatgcatggaatctggtcagatgcagcggtaattactattatgtggacactacgtggggagatcccgtattccaggcggcggaaggggaagaggtgaaccagcagcagatgatcagttatgactacatgtgctgcaatgatgaggaactgttcaagacccatacgccggatcaggatgtagcgctgccggcctgtcagtccatggcggaaaactattatgttgtcaatggcatgtattatgaatcttatgacagcaaagaggcgcttcagaaaatgaatgaagtcatatcatccaggtccaatccagtggtctttaagtttgccgacagcggattgtacggccaggcccatgactccatcctgcaggacgtagtgcgaagagccgcccagaatctggcagactggtatgggcttggggaggtgaaatatcaatacatggatgagccggaattgaataagattacgatattctggcagtacgaataaaaattatgttgaaaatccatcctttttgtagtataatttttacaatttgtgaagacaaggattgtcgacgataaaatggtagaggaacaggcagttgtgtgctcgcacagactgcctgtttttcaaaaagcggcagccttaggctcccagatacaggaagggagcccgcaataacagcaaaaggaagggaaagggtggatatatgaaagcatttctaatactagaagatggaaccgtctttaccggaaccagtattggctccacgagggatatgattagcgagattgtgtttaacacttcaatgaccggatatcttgaggtgttgaccgacccttcttatgccggacaggcagtgacaatgacctatccgctgattgggaattatggcattacgccggatatggaatcgaagaaggcgtggcccgatggctacattgtaagggaactatcccgaatgccaagcaatttccgctcgcagggtacgatccaggagttcctggaaaagcaggacattcccggcatcgcagggatcgatacccgggcgctgaccaagatcctaagggaaaaaggcacgatgaacggaatgattacaaccaatgaggactatgacatcgatgaagtgataaccaggctgaaggcctacatagttggcgacgtcgtatcagaagtctcatgcaatgaaccatacgtcttagaaggcaatggaccaaaagtcgctctgatggactttggagcaaagaataacattgcccgatctttaagccggcgaggatgcaaggtgacggtatatccggcccatacttccgccgaagatatcataaaagcagatccggacggaatcatgctgtccaacggtcccggagacccagagacctgcgtatctattattcaggaaatcaagaaattatacaattcagacattccaatatttgctatttgtctggggcatcagctgatggctcttgcgaatggcgcaaagacatacaaattaaagtatggtcatcggggcggaaaccatccggtcaaggatctgagcagcaacagagtgtatatctcgtcccagaatcatggatatgcggtagatgcgtccaccatggatccatccattgcgaaagaggcgtttgtaaatgtgaatgatggcacgaatgaggggctttcctatgagggaaagaatatcttcaccgtgcagttccacccggaggcatgcccgggaccgcaggattccggctatctgtttgaccggttcatggatatgatgaaaggagcgagataatgcctaggaataaagagataaagaaagtattggtaatcggctccggcccgatcattatcggccaggccgcagaatttgactatgccggcacgcaggcctgccgttccttaaaggaggaagggctggaagtggtgcttctgaattcgaaccctgccaccattatgacggacaaggacattgcggaccgggtatatatcgagcctttgacggtagaagtagtcgagcagctgatcttaaaggagaaaccggacagcgtgcttcctaccctgggaggccaggctgccttgaatctggccatggaactggaggaaaatggcttcttaaggcgcaataatgtgcgtctgatcgggaccacctccgagaccatcaagaaggcggaagaccgtctggaattcaagactaccatggagaagatcggggaaccttgcgcggcatccctggtggtggaaactgtggaggcaggcatcgagttcgcggaaaagatcggctatccggtggtcctgcgtccggcctacacgctgggcggcagcggcggcggtattgcgcaagacagagtgcagctggtggaaattctggagaatgggcttcgcctgtcccgcgtggggcaagtcttggtcgagcggtgcattgccggctggaaggagatcgagtatgaagtgatgcgggacggaaacggcaactgcatcaccgtgtgcaatatggagaatctggatccggtaggcgtgcacacgggagacagcatcgtagtagcgccttcgcagacgctgggcgacaaagaataccagatgctgcgtacgtctgcgctgaatattatcagcgagctgaacattaccgggggatgcaacgtgcagtatgccctccacccggagacctttgagtactgcgtgattgaagtaaatccgcgtgtcagccgttcttcagccctggcatccaaggccaccggctatcccattgccaaggttgcggccaagattgctttgggctatacgctggatgagatacgaaacgcagtgaccaggaagacgtatgcaagttttgagcctatgctggactactgcgtggtaaagattccaaggcttccttttgataagtttataagcgcgaagcgtacgctctccacgcagatgaaggcgacaggggaagtgatgagcatctgcgataactttgagggggcgctgatgaaggctatccgttcgctggaacagcatgtggacagcctgatgtcctatgattttacccatttgacggatgaggaactgcaagaggaactggccgtcgtagacgaccgccgcatctggaagatcgcagaagccatccgaagaggaatggggtatgaagagattcattatatcacgaagattgatcaatggtttatcgacaagatcgccattcttgtagaaatggagcaaaaattgcagaaccattctttaaacgcacagacattgagggaagccaagcgcctggaattcccggacagcgtgatcgcaaggctgacaggcaatacagagcgccagattcatgatatgcggctggagtatggaattacggcatcctataagatggttgacacctgcgcggcagaattcgcggcagagactccttactactattcggtgtttggcagtgagaatgaggcggtacagacttccggaaggaagaaggtcctggttctgggctccggcccgatccgtatcggacagggcatcgagtttgacttctgctccgtgcactgtacctgggcatttgccaaggaagggtatgagacgatcatcgtcaataataacccggagacggtcagcaccgactttgatatcgcggataaactgtatttcgagccccttacgccggaagatgtggaaagcatcgtagacttggagcagccggacggggctgtggtccagtttggaggccagacggccatcaagctgacggaggcgctgatgaagatgggcgttccaattcttgggacatccgcagagaatgtagacgcggcagaagaccgggaactattcgacgagatcctggagcagtgccagattccaaggcctacaggcgggaccgtatttacggccgaagaggccaaagaagttgcagggaggcttggctatccggttcttgtaaggccatcctacgttcttggaggccaggggatgcagattgccatcaacgaccatgatatcgacgagttcatcggcatcatcaaccgaattgcccaggatcacccgattctggtagataaatatctccagggaaaggagatcgaggtggatgccgtatgcgacggagaggatatcctgataccaggcattatggagcatatagaacgggccggaatccattccggcgatagcatctccgtgtatccggcacaaagcatatcggagaagactaagcgtacgattgaggactacacgaagaaactggcgcgctctttgcatgtcattgggctgatcaatatccagtttatcgtgtgcggggaggatgtgtatgtgattgaggtaaatcccagatccagccgtacggttccgtatatcagcaaggtgacgggaatccccatcgttcccctggcaacgaaggttatcatcggacataagatccgggagctgggctatgaacccggacttcagccggaagcggattattttgccgtcaagatgccggtattctcttttgagaagatccggggagcggatatcagccttgggcctgagatgaagtccaccggcgaatgcctcggaattgcaaggacctttgacgaggccttgtacaaggccttccttggcgcgggcatcaagcttccaaagtataagaatatgatcctcacggtgcgggatgaggacaaggaagaggcggtggagatcggccgcaggtttgagcggatcggataccgtatatttgccaccagaggaacggccgaagccctgaaggcaggaggggtgaaggccaatgcggtcaataagatcgagcaggagtccccgaaccttatggatctgattctgggacataagattgatcttgtcatagacacgccgcctcagggagcagaccgttccagggatggattcgttatccgcagaaatgccatcgagaccggcgtcaatgtgcttacggccattgatacggcaaaggctttgatcaccagcctggagaacacggatatcaagaaactgacgttgatcgatatcgccaggatataaagataaaagaaccggagtctcaaactctctttcagagaaacaagcgatatgacaggcttgtattcctgaaagagagttttttaaatagtttgcagatgatctgatcattttgctttcctcacccgttatctatataggggacgcccttaaggaggattggttttgacgcgcgaaaatgaactgttacggaaaattgaaaaaggcgatgcatcatgctgggaagaactggctgccatgtactacgacgacatcctccgctactgcctgtaccacaccagggatcgggaaacggcagaagatgccgtacaggagacgtttcttaaggtgatccgctatttcccaagatataagaataaggggaagttccgggcattcctatataaggtagcttccaatacttgcgtggacacgtggaggcagagcagggaaatgcatctgacggaacagatcgaatatcaggaggcagggtttgcgcattctgaatccgaggaagggttccggcagatcgtggagatgctgcccgaagaccaaagggaagtcatatacctgcgttttgcccatgatcttaccctgcgggagaccgccaaggtgttgggaatcccgatgcgaacggtccaatcccggcaaagagccggattaaaaaagattgaagaaaagatcggaaaggaggaagcgcgttgagaaaaacgttagaaaaagaactggctgcggcgctgaaagcaaaacttccagagaatacagacgcgcataaagagcagatgctggaatccatccggcagatgcaggcgcttaagcagagaggaagaaagataggatttataagattcctccttcgacaggttccgtttgtagcaaaaaagctctgggcgatgcagggacttatggctatggcagtattcgtagttttatatagtacgctggatggggatcttgggtatctcggcatccgccatatcccggctttgctgggagggctggcggtatctcagatcatgctggcgataccgttcatgcaacgttcattccagtatcgcatgtatgagatcgaagcgtctaccagactgtcctatacaagccttgtcatggcgaatatgatcctgatggcagcaggcagcatggccgtattttccatctgtgccgttgtgacctcgattggcctgaaactgccgggcatggatatgatgctgtatttccttcttccatttctcgtggcaggcagcggatgcttttggatactgaatggaattagaaggtccggaaatcaggatgtggggaccggaatctgcgaaggatattgtgcaggccttatggcggcattgctgcttctagccaaggcgatgccccaggtctacgaaacgatggccgcgtggcgcatagccatgctgatcatgctgccggcgtcagccgtatctgtatactggtttatcagacaatcctcgccagaaaggagtgcttatgaaattagaaatctgtgatattacaaagcaatacaaagacaagcgggcagtggatcatgtatccctgacgctgacgcccggcatatgggggcttttgggagccaatggcgcaggaaagaccacccttatgcgtatgatagcaggaatccaaaagcctacatcaggatgtatccggtatgatggcattgagattggaacattaaaggaagcctaccgggatgtctttggatacctgccgcaggagtttggattctatccaggcttccatgtgtgggagtatctggaatatatcgcggctctcaaaggccttggaaaggcggagacaaagaagaagattgaagggcttctggaaatgctgtcgcttcaggaggtaagaaagaagcagatatccaaactgtccggaggcatgaagcgcagggttggaattgcgcaggcaatgctcaatgatccggaagtgctgatcttagatgagcctaccagcgggctggacccaggagagagagtccggttccgcaaccttctctcagaatttgccaggggcaggatcgtgctgatatctacgcatatcgtctcagatgtggaatatattgctacctgcaatgcgatcatgaaagaagggaagattattgccaccggggagacggaaaaactggtgcgggaagtggacgggaaggtatggaatgcccagatcgatcccagggagcttgcagcttttgaacagagggtgccaatactaaatgtctataataaagaggatggagacttgcaggtccgctatctggcggattcggctgttataccaggctcagtaaaagcggagccacgaatggaagacttatatctgtggctgttcccggaacatgcaagagaggaggcagtaagatgagactgttatgcttagaactaaagaggcttgttaagacccgctcaacctggatgcttcttgctgccgccttgatcctgtcagcggtactggcatattttcccatatctttcgtgacttcctataagacagatgcaaaggggaatacggtgaagcttacagggatagaagcaatccagaataagaaggagcaggagcgggccatagccgggttgataacggaggaaaaggtggcaaaggcagtcaaggactttcgggaatgctatcaggaatatggaagcgcttttcctccggaggttccgatggaggtgtataatgagaagatagcgccccagtatccggttctggaacaggcagccagggtgcttgcagattctcaggtgtacgtggataccatgacggacgcggatatttctcccgaagatgccaccgggttttatgaaaaataccgggaacgtttgaaacagatgggaaaggatgagaaagagcaggtagagatcgaaaggctcagcgcggatattgagacgccgtttacctatgtgccggggttttcttcggaatcctatgattatctggtcttgtatctgtttcttctgatgtttatcttcgcggttatcgcagcgcctgtgttctgcgcagagtatcagaccggcgctgacagcatccttcgctgcgctaagtatggacgcatgcggctggctgctacaaagatcggggccatgctgatcattttcctggcgacgttctgcgcgggaaccgcggtcttccttctgattacgaatcaggccttcggatgggaaggacttcaaacttccctgcagatgctgcggtcagcattcgtgatgccgcagatgacgctgggagaggcctggacaactgtcgtgctggcaggcttatgctcccttcttgccacagtctgtgctgccctatatctgtcttccaggtgcaggaacgtgcaggctgccatcataggaagcattgtcctgtgcatgctgccgaccatcatttatatggtgtcaagcagcaatgtggcagacattctaagatgtatattcccatcagggggaatcggcttgacgaatagttttttctatgaattgatgggactgcattttatccaccttggcactggatatatctggacgccgtatctgatcatgggcgccgcaatccttgagattccgctgtttctggtgttgaccgcagtgacttactgccgtcgggaatctatttagatttgacagaaatgtgaagatatgttacgatacccaccgttgcaaatgtaacaaatttgtaataattgtaataaagttgaaatttttgaatatactttattaagacaatgttcatgcattgcaacaataggagggtataaattcatgataaaaaataagagactgagttcgatgttcgcgctgttttcagcctgttcattgatgacagtaggatttaccagtcaggcagcctctttacagccggaagtaaagactgcggtaagtacgaaggagaatatagcgtctgaaatacaattgaatgccttgcaggcagttccggccaatatagtaacatgtgccaattcggcagtagacgaagaagtgaaaatagcagccgaggaagcggcaagaagggagcaggaggcgagagagcaggcagagcgcgaagccgaggctcaaagagccgcggttcttaagcaaagccagacgcttcttgcgtccatcatcttctgcgaggccggaaaccagccttatgagggacaggtagccgtaggagcggtggttatgaaccgcgtaaacagcggcatctatccgaacagcatagaggaagtcatctaccagcccggccagtttggcccggtatccacaggatggctggacaaagtcagaagttccggcggctataccgattcggccatgcaggcggcggcagacgcgctgtcaggagccaatccggtgggcggatgcctgtattttgaccagggcggctatggcatgaggattggagaccactacttccattaatttgacaaaaccacaagaattgtataggatgaaagagcaggggatattaagtcttctgctcttattttaacttgcaggatggaggaaaatccgtgtatagaatattagtggttgaagacgacatgaccatcgcaaaagcgctggcatcccatttgcgtaaatgggactatgaagtggcatgcgtagaagactttaagaacgtaatggaaatatttgcggaatatgatccgcagctggtgctgctggacatcgtgctgccattttttaatgggtttcactggtgccaggagatccgtcagctgtcaaaggtgcccatcatctttatctcttcggcgggggataatatgaacattgttatggcgatgaatatgggcggggatgaattcattgaaaagccctttgacctgaacgtggtgacggcgaaagtccaggcaatgctaaggagaacctatgcattccatggctctgccaatatcattgagcatcatgggcttctgctgaacctgggggacgcatctctatcctaccagggcgaaaagatcgagctgactaagaatgaatttaagatattccagaccctgcttgagaacgcgggcaagatagtcccgcgggatgatctgatcacccggctgtgggagagcgacgagttcattgacgagaatacgctgacggtgaatatcgcgaggcttcggaagaagcttggcattgcgggcctggaagactggatcgtaacgaaaaaaggaataggatatatggtgcaggcatgagattgacaggaagatatatcagggatcatatcaggggaataggcatgtacgccgggatcatggccatatttgccttgctattctatttgtataatatcccaatggatgcgctggaatacgccttgcttctgagtctattgtggattcttggatttgtggcggcggattttatgaactgcagaagaaagcacagggaactgttaaggatgaaaggaatcctccaggtaaaatgggaagaattgccgaaggcggataccttggcagaatgggattaccagcagatagtaaatgcactgtttgagagcagaagcgaactggagtcggcggcgcagctaagcaggcaggatatgctggactattatgtgctgtgggctcatcagatcaagacgccgatcgccgccatgcgtatccttctgcagtcccaggaactgacggaagaaaacgaagaagcggttaagactttgaagatggagttatttaagatcgagcaatatgtggagatggtgctgacctatcttcggatggagtccatgtcctcggatatggtgcttcaatggtatgccgcagacgatatcgtgaagcaggcagtcaagaaatactcccagctgtttatcctgaagaagattgcgcttcggatggacatgccagaggagatgatcctgacggatgagaagtggctggcatttgtcgtagagcagatattgtccaatgcgctgaagtataccagcgaagggacggtgtccatctatatgaaggagaaagaactggtcattgaagatacgggcatcgggatccaggaagaggatgttccacgggtgtttgaaaagggatttaccggatttaatggacgaagggacaagaaatccaccggcatcgggctgtatctgtgcaagacgattctggacaggctgggacacagcatccgtatagagtcgaaggtgggagagggcacaaaagtattcctctatcttgaaagggatatgcttgatccagagtaagcggacgcccggcaaatcacagaagctgttccaacgcctgctgatctagcaggatcaatacatggcctttgatgcggaaatatcccgcgttctccatatgcttgagttcctggtttaaggaagagcgggatacatggagagtattggcccagactgtctgagatctggggaggggaatatgctcatcctgggacaggttattcatgctaagaagccagaaggcgatccgctggtgaatggtctgataatgaaggcagttcagcaatgtctggttcttcattccccgatgggcgatatacagcataaaggaatagagcatatcgtgatcttcttgtatcatacgctcaaaaacagaagccggcatccaggcgacttctgttttttttacggcgatgagggaataggaatatattttattcccggtaaaatagaggaactctggaaagatgtcattatcctcaaagtatgcgcagaatacatcatcgccattgacggtatacttttccgccttcaggcagccatccagtacgatgccgaactctttgatcgcggcacctattggatgaatgacatatgctgtcttataggtttcataacgcaagtattgagcataggtcttatgatgcaggcattgataggcaaatgtcgtatccaccagagtccctccttgcttttatacgagtgcctgatccaggaaatcacagacatcatcgtagtctcgttctccattgaaacgctgtatctcttttccgtgctggcagaccattacgacaggtatgccttgtacgttgcatgcgtccacgatatccttattctcatccacattgacatagcggatatggaaactgtcgttaaattcttcattcaaggcttcctcaaggaccggatgaagtgctttgcagtgtacgcagcgttcagcgccgaataagatcagaacaggcttatcgtcttgtttcagtaccatgtcattccaatctgacatggagttgaccggcttaaatacatccgtgtcaacttggaagatcttctctcgctttgacaggtcttcctcatcatccgtcgctacgcatagggcaacgtcctgataataaggaagggttccttctacattgacaaacgtcttggcgccaaatgatccagcgtttggcacgcggaattcaatgttgttgatcggaggaatcggtatttcctttggcgcaggctcctgcggcacataactgtaaggatagcggtaggcgcgatagatcatgttgttctttgggccggtctcgttgtgcgtatagtagggggagatccactcccatacgatttcatgatccgttgttacttctattatacgcccgtcgcttccttctgtcacgagggtatttccatttggcaggcgctgggcgctggaaacatagggactgtagaacttgcttgcatccgtaggaattgcgtttccaagttccttgggagtcagtttccatacgacttccaaagtaaccggattaaattccagtacgcggctgtaatcacgcaaggcatttttcgagccgttcctggagcctgggtttggcacgccatagccggcccagccgccattgtcgaataccagcagattgccttctcccggaagaccctttggtatcatgtggaaatgatgctgtccgatgatccagcctaatttcctgagttcgggagtcgcgttaaagtccggcccgatcctccagacgatatgcccggtctctttatccaggatcgccagaatattggactcgcggcagtcaaagataatgttgtcaggcttgaaacgctggtcgccctggtcataccatttgttaggcccgaggtagctcatgcagttgacgtgctgatagtcgccaactcctccgtccgatgaacgcatatttggattccgggccaggatattaagggcggcctcgtcaaatccaagttcgtcaaagtgatcggtgatggaccatttccacaggatgtttccttcccagtctacctcgatcatgcagtcatccagcagttttttgtcggataccttgggattgtgcagcgtctggtgtaccaggatcagagtattgccttccagtggctttgcgtccatgccgggaacataatatcctaccggattgccttcccgctgatagtcatggtgctggcgcgccatccagcggtgatcccttccagggtcgttgatttcctcaaacttgtcaaattcccatatgatatttccgtcataatcgatctcgatcaggttgacgccgtcctgcattccataatcaggatgacggtagccggataatcccatgacgtatccgccgggcagaagcttaggcggcatggcctgcatattccaccttctgatctcgttgccgttcatgtcgaagagcagcacgccgtcgttgatcagcggcacgatggtgtatccgttccagcatttctccgggttatagactgttactccgtgagggaaaacacttggctgtcccataattcattcctccattctattgttccacttttataagtttaccgttatcatagtaagcgcaggccggcgatgcatgcagatccagccggtcatataataatgtctgccttgtaatgtcctggcggacaatctgatagctgtccttcaggcttagttcaatctgggtggctttctcgatctgcgcgctgtcataaggattgtagaagatgaaagcgatcttgccgccgtcaggggccagaagggcatccagctgcttcttctcttttacatagcgctcgctggcggttgcggcaaccgcgccgtcggcagcagaggtgacgatctggcgcaggaacgtctgcgtgcagtcgccgatggcatagaggcctgggacattggtttctttcttctcgttggtcttgatatagccttttgcgtcgcattctacgaggtctttgaccagatctgtctgcgggatcatacctacaaagaagaagatgccatccgtctgtacttccgtgctggctccagtcactacatttttgatcacaaggctttctaccttatcctttcccttgatctcctgcagggtagaattccatatgaactcgatcttagggttctcgtatgctgtcttcgccgccacttcattacagtccagatgcccttcttcgtgcagcacgatgatggagacctttgtggcaaagtctgtcagataatcagcctcttcaattgcctgatccccggcacccagcacgtagatctcttttcccttgaagaattcggcatcgcaggtcgcgcagtaggcgacgccatgcccggcaaattcaacttcgccagggatacccaggattctgggtttggtgcccatatccaggaagatgcatctggcttcaaagtcgccgcgccgtttggtacggaccagaaaattgccgtcctcctccttgaggatctcggttacggtcgtacgcttgaactgattggtggcatagctttgggcatgggcccggaacttttccatcagtccggaaccgctgtcggttatggttcccggatagttgcggatttcccttgtgtcattgacgcggccgccataattgcctttttcgatcagcagcgtcttgcgctgcgcccgtccggcatagatggctgccgaaagtccggcggggcctccgccgataataatgacatcgtacatctcgttcatgtttaccactcctttgcttgtgtttacagttacagatattctatgacttctttctgcctaagcctaaggtgatccaggcgatacagataatggtaaggatcaggcagtaataagaagagacaaagatttgaacaggggttacgaggggcagcaagttgtctttttctgccattccctgtattacggtaacagcccccatgacaaatgccgagttgatcggaatgatggccgtgatatttgtggacatggcagtcaggaggatgcttcgcctgctggccttaatgccggccttttgcccaacttcgtccgccacatccttgaacatcaggatgctgggcaggacacagccggccagaaagatattgacgatccctacgcccagagcaatgattgattcagcgcctgccggctttttgatcatcttgctggccatgaggaagttgcagcattttcgcatcatgccgccttccacggcaatctgtataaggccatacagcaggattgtggatataataatatcagtaacgctggctattccgtcgaagaatacgccgtgcagctgctgggtcttcgcatcaattgccaccagatcctgcaactggtagaggccgcttacaagtcccaccacgattccagtcaggattcctccggtcacgccaacgaacaagtctttggtcttaaaacaaatgatgagcaggaccacaataggaaccagcatcagtagacctttaacattggacatggaagcaacttcttccatgtctcctcctgcgctgcctcttcctccgagaataaggaagaggacagctgacaggacgcctgcaaacaggatataaggaaggcgttctcgcattgtttcaagcaagtccgcgcttttttgcgtatcagcatcatgctgggatgcgatcgtggtatgtataacctgggaacttggcgaaagcgcatctccgaaaaagattccgctcatcatgctcccgatgagaatggcaggattggtacccatcataatgcctgccggatagaagataggcacgacggcaagcagcgccgcgataggagcgccggctcccatggagatgactgcgcttccgatgaagacgaacagggcgaaggttcctccctgaagtcccagatgggcgcccagccagatgaagccgcctccgatatctccgattaccagaactttggaaaaaataccaattaccatgaagataagaatcaaacgtgcatttccgtacttggcaagccctctgactactgcattccagaaatcgattttattcttacagaagatgaagccagccaggatggagatgatggcagcaagtatcagcactttcattgagtagcagtgtgtcgcgatcatgatcacgccgcttaggatgacatacaagacgatgggtaagactgccagtccctggcggccgtagaactttaacgtatcttcgctatcttctttcatttttacaccagctctccttttgatgcctctataatagcacccttctttttagaaaacttgttggaggtctaacacattgataaaaaattattctaataatatctttataaaaacgaatataataagaagcgtatttatgatatcctaaaagaacaaaaagctgtgaaactgaaggaaggaatattacattagatttcttaaaaatcctgtttataagtaatcaaagtgcttatttgtgacaaatttgtaaggttgggccaggagaatgtaacctgattcgatggaagcagaatactggataatctataatatgatttgtaataaacaaagaatagatgaaaggacgggaatatgagatggctttattagaggtaaagaatgtaaagaaaatatacactacccggtttggcggaaatcaggtggaggcattaaagaatgtgagtttctccgtagaaccaagagaatatgtagcgattatgggagaatccggctctgggaaaacgacgcttcttaatatcctggcttctcttgacaagccgacgggaggcaaggtgtacttgaaaggaaatgatctgggaaagatcaaagaaaaagagatggcggcattcaggcggcagaatctggggttcgtgtttcaggactttaatcttctggacacgttttctcttaaggataatatcttccttccgctggtcctgtccgggaagaagtatgacgagatggagaagaagatcaagccgatagcgcagcgccttggcattgaaaaactgctggaaaaatatccctatgaggtatccggcggccagaagcagagggcagcgatcgcaagggcaatcatcacaagaccccagctgatcctggcagacgagcctaccggcgcgctggattctaaggcggcagacgaacttttgacgctttttaacgccatcaacgaagacggacagaccatcctgatggttacccacagcgtcaaggccgcaagccatgccaaacgggtaatgtttattaaggacggggaagtgttccatcagctctatagaggaaatcttacaaatgagcagatgttccagaagatctctgacacgctcaccgtgttgactacagggggtgagcaggttgaatagttcagtttatggaaaacttgcggtcaccaacctgaagaataaccggaaaacctatattccttacatgctgacggcgatccttacggtcatgatgttctatattatagacgccttgtccagaaataagagcgtgggagacgggaatctgcgactctgcctttcctgggcgacggtagtcatcattgtatttgccgtaatcttcctgttctacaccaacagtttcctcatcaagagaaggaaaaaggaaatcggcgtctacaatatattgggaatgggcaagcggcatattgccaggatgctgaccattgagactttgataatagcggttataagcattgtcgtcggacttgtagcaggaatcatattcagcaagctgatgttcctggctcttttgaagatcatccattatgacgtaaatatggtatttgaactctcagtaagagcactcctgaatacgctgctcctttttaccgtcatattcgccatgacgctgatctataatctgctccagatccgtctctccaacccggtggaactgctaagaggcggaagccagggagaaaaagagccaaagacaaaatggctgctgaccatatttggagtgcttgccatcggaatcggatattatatcgcgatcacgacggaatctccgcttaccgcgatcacgttgttctttctggcagtcatctgtgtcattataggaacctatgcgctgtttacagcgggcagcattgctttgctgaaacttctgcggaagaataagaattactattataagaccagccattttacttccatatcaggcatgatctaccggatgaagcagaacgcggtaggacttgccaacatctgtatcttaagtaccatggtgctggtgatgatatccaccacgatctcgctgtataccggaatgaatgacgtgctggaaaccagattccccacggaattcgaggcaaggaattataatgccaccgaagagaatatgaataagatcgaccagatcattgaggaagaggccgcaaatgcaggcgtgaagataaagaaccaggtcagccacagggaagcaagcctgtcctccatccgtacgggaagtgatttttccctgatgaatgacggaaactatgcggcggaagatctgtgctcgctgatcttcatcagccaggatgagtataacaatctggctggccagaacatttctctggcagaagacgagatgatggtatttgtggatacagaagacacttatggcaaagatacggcaaagattggatcagccagctttaaagtggtcaaggagttaaagaagtttccactagccaagaagagccagggacggctggcgcctaccttttacatggttgtcaataacgagaatatcatgcagcagtttctagacgaggcatatgctgacagccagatgcagattgaatggaaggagcagcaggtcaatatacattatatagtcacatttgatctggaaggcagccagaaggcgtgcatgaaagcggaggaatcgatcaagagccgggtagagtccgagaccactccgtcattctgcgaaagccgggaactgaaccgggaagggttctatatgctgtacggcggccttttgttcatcggcatctatctgggcgtcatgttcctgatggcgactgtgctgatcatctactataagcagatatccgagggatatgatgacaaggagcgctatcagatcatgcagaaagtcggcatgagcaagaaagaggtaaggcattccatcagaagccaggtgcttaccgtgttcttccttcctcttatcacggctatcatccatatcatcgtggcctttaaggtaatcaccaaattgctggccgtgctgaaccttgtgaacgtgccgctgttcatggcgtgcaccatcatcacggtggcagtattcgcagtgttctatgcgatcgtgtacggcctgactgccagggaatactataaaatcgtgaattagaatcaatgccggtcatgcgggcagggacatagcattttggaatcgtgcgtccctgcccgcgttttattggcgtaaaagtttagtgcctttttatgattttagtggtataataatacctacttacataaaacacttaacgaaggaggaattggtatgaaattggtgattacgatgagccgcagatatggtaccggcgcgagcgttattgcagaggaactgtcaaagaggcttgggattccggtatatgacaaggtaaacgtggaacaggaactaagcaggaatacctatgaatccgaagtggaggcgatcaaagggctggcacagaagccatgcattatccttgggcggtgcgcgtcagagatcttgaaagacaggcttaacgtgttcaatatctatgtgtgcgcggacaaggaagacaggatcgaacgtattatgaagaaggaatctcttacatacgaagaggctgcccagaagattgacgcgaacgacagggagcgttccaggtattatcatgagcacacgggcaaagcctggggcgacgtgaataactaccatatgattctgaatacttctgatctgggcgtggagaactgcgcggatatcctgatgaggtattttgagcagaaagaatatatctaatataaatattctgataaattatgataagaaagaggaggaacagcacaatgacaaaagcaggagaaagagaagtagtaaaggtagagcgtgtaaatggcggagccggcttcattatgaaggaaggacttttgagccaggaggaattaggagagcactgcaagatgttcagcagggtgacggtgcctgccaactgcgagttgggacatcatgagcatcatggggagacagagacgtattacatccttagcggaaccggaatgtacgaagacaatggcaaggcaatccccgcagaggcaggagacgtatttttctgcaaggacggagacggccatggaattaagaatacaggcacagaagacttgacatttgtggcattgatccttaagaaataagaaggaaaaaagacagggaaggccgccaaagcgtggagaagcatatccacacttggcggcctttcttttctcgccaccggtcttattgccgggccttaagcgcacgtttcaggcagtcgagcagccggccgttctcttgtggcatcaggaagcagaagcggatatactcgccttccagggtttcgaaagaggaacagtcccggatcatcaggttctcatggatggctgcctcaaacagatcaaaggaagtaaggccgtctttcagaatccgtatgaggacgaagttggcataaggcttatatatctttaatccttctatggcatttaactcctggcagacgcgggtacgctcggagtcgatgagattccaggtggcctgaatatacgcgctgtctttgagcattaattctccggcgtaggccccgatgctattgaggctccaggggttctggtggagaaggagggcagagaggagttccttgctgccggtaattccatacccgaatcttaagcccggggaggcaaaaaacttagagacgccgcggattaccataaagttatcatatctgctggcaagagggattgccgtaatgtcggacggatcgggggcgaactccgcatacgtctcgtcaatcatgacgaagattccttttttcttacaagcgcctataatacgctccatgtccgcttgatgtatggcggaagaggtgggattattgggattgcagaggatgaccagcccgatgtcatccgtcagcgcctgaagaaaatcagggatgtccagcacaaaatcctgagattccttcagatggtagtactgtaaagcgccgccgatcagggaaagttccctggcatactctgaataagtgggtccaaggaccagcgccttcctgggtgagagctggctgatcagaagagagatcagttccgtagagccattgccaaccatgatatgcccgggatcggcgtggcagtaggctccgatggtctcacgaagacttgtataatcccggtcaggatagcgggtgatgacatccagattggcggcaagctggctctttaccttttcggacaatccgaggggattgacattggcgctatagcagatgatatcctccttgcgcatgtgataataacttgcgatcttttccagatcgcttccgtgaaattcaggcttcttttccatatctatacatcctattcatatattttcgagattttgtatttccggcattgccattacttatgaaacaatgctataattcattatagtatgttttttgaaaaatgcaacgaaagaagcaggtgtcagacttgaaaaataaaatccagaaattttcaaaaggagactttcagttaatacgacctgatgtcatatttgatgaaacaaatctggttctcataataggagaaggggaagtatacaggggaagttttacaatgaagacgaatagcaaagggacgatacggggacttgtatacccgtcttcttttcgtgttcattttaaagaccagggatttgagggaaatcccgcaaaagtagaatttacgtatgacggcaggggactgcgccctggccatgtggaggaaggcaagtttaccgttgtgtgtaccggcggagagtatgaactgtcttttaccgccattatagaaaagccgtatgtcatgacctcctatgggaaggtgcagagcacggatgatttccggaaactggcgatcaaggatttctcagaagcagggaggctgttccgctcccgggaattctatgagatattgaagtatgagaatgaaaggatattctatctgtacgacaatatgcgcaaatggtcccttggggagcaggccatggaggaattcctggtaggcatcaagcagaaagagtgcatctttctgacccttcccggggagggaatgctgtttgaagacatcggggagccgacgaagggaacgcttacgctgatgaagaacacctggggatatatgcccatccggatcgaggcagagggaagcttcatcaaggttctgcgcccggagatcagcaccgaggacttcgtgggcaatgcccatgagatcgagtatgtggttcggccggagcggctgcacggcggcaggaattacggcgctttgaagttcgtgactccctatgagacgctgacctatgagatcgaggtgctgcagaatcaggagtatgacgaggatcacagaatcccggaacttttaagcgcgcagatattgaaggaatatatcggctatgtgggcggaaggatcgaactgaacaactgggtggagagcgcggttgagaagatggccgtcctgagaaaaaaggaaccccagaatgaagtataccagctccttcaggcccatatttacctgattggaaataaagtcgaggaagccaaatggattctggagaattataattacaaccggttcgccatcggcaaggatccggtgacgaactgctattacttatatctgaccgcgcagatcagaggccagggaaaccatgttgaccgggtgcttgacgagattgggaagacctatatgcggcatcaggattcctgggccctccttcgcatgatcctgtatctggatccgcggtataaaaatccttttaaaaagatcgaagtgctggaacagcagttccaatatggcatccatgaggtcctgttttatctggaagcctatatgtgctatcaggaaaagcccacgcttcttaaaaaactgggcgcttttgaaatacaggttctgaattttgcttccaagtatcgtctgatgacgaaggaactggcgctgtatgtgtctaattttgccagccagcagaagaactacagcgatgccatgttccggatattggaacgcatctacaagatgtacagcgagcctatgatactgaatacgatctgtacgttgctgatcaagggaaacaagacgcagcagcgctattttgtgtggtatcagagggcggtggacgctgaacttaagattgcccagctgtatgagtattatatgatgaccatagacgagaattccgcaagagggccgcttccgaagaccatcctgctctacttcatgcatgggaattctctgaattaccggaaggcggcatttctatatgccaatctggtcacctacgaagagactgcgggggatctgtacctgaattatcgggagcagatggtcgcgtttacctgggaccagctgctaaagcggcatattacggagcctctgcgaatcctgtataagaggttctgccaggaagaagagatgacggcagagcgcatggaggccatgcgtgatatctgctattcttacgagatcaccacaaaggtgccgaacatgaactgcgtcctggtgattgaaaaggatggcgccatccgccagcgggtgccttacgatgaggatgaaggtgccgttatctacctgtatgataaggaatccagaattgtatgggagtctatcgaagggcgtcactatacggattccatcgcctatgagaccagaaggctgttctacgagccaagattcttagatatgtgccgcaagtatgcggcatccaccggcgtgtggaagcaggagaacgaaaaggaagagccgacgtttgagaatcttcggatcaaaggaatcagcgcttttgatgagaaggatgtcttccgcctgtgcagcaagcggatccgggaagacaactatgaggaagatgaattcctgaattatctgtgctttgaactgtttaaaatgcagcagtatgataaggtgactttgatgtatctggctaactattactgcggggccaccagggatatgaagcggctgtggaaggtcttaagagaatacgcgattccttcctataaggttggagagcgcattattacgcagatggtcttttcggagaacctttttgcggaggaaaagatatttgaagactactatctgtctgacagcgtgtatttccggctgaaacaggcctatcttgcgtatgtttccagagaatacgtcgtatttggaagggacttggacctgtgcgtgttcgatatgatagccaacgagtgcgacaagaaggagtatctgccggatatctgcaaggtcgcgcttctgaaatactattccagccgtgactatacggccgagttagaagacgtgcttcactacgtcctgcgggagatgtgtgagaagcagatcgtatttccctattacctgaagtataaggaagaatggctgagggaagtccaactctatgacaaggtgatgatctcctatcagtccaggcctggcagcagggtaaaactgtatcataagatgaagcagggaatgcgggaaggactgggctatcagtcggaaattctgatgccaatgtatgagaatctgtatgtaaagcagtttgtattatataaggatgaatccatcaattactatttccaggagacgaatgggaaagacacgatcacgacggagaaaaaggaactgcgcaatgagagagaatttcctgacatcggcaagtttggaaggctgaacggaatggctttgatgggccctgcgaaccgcaggcaggcgatgctggaattccaggaagaagaaatcctggcggaccagatgttcaagatatattagaagaaggaggatatgatagtgagaacaggcagtattctggggtatgacctgaatgaaaagcattgtcagatcagttattacgatgagaccaaagacgagccggagacattggaagtagccgtagacaattatcagattcctctgatgctgggatactataaagaccactgggtctacggaaaagaagccaaacggctggcgaccatcaatgaaggctgtaccgtagcggacctgtttggcaaggcggtacggcaggaaaaggtgagggtaggagccaagacccatgacgcggtgtggcttctggccaaattcgtaagccttacgctggaaaaattcgaagatatcgcattcattactttttcggtgccttttaccaacattgacatgtcgaagatgctgaaaggaatcgggcaccatctgggcgtgccgaaggagtacgtgtatgtgcaggattataaagaaagcttctgccagtacatgttctaccagcccaaggaactgtggcagtacgagtctgccctgttctactgcgatgcccaggagatccgggcgtatatgctcagaaaactgaataccatcagcggacggggaaatgatatgttcgtaaccgtcgacgaagtggcaaatgctcatatgaaagaactggccgccatctatccggtgctgaatgtggacaaggcaaaggatgcggatgaaaggttcaagggcttcatccagagcgtgtttgaaaagaaggtggtatcttccgtgtatctgacgggggaagggttcgagaataactggtatcccaattccctgaaggtgctgtgcaatggccggagggcatttcttggcaacaacctgtacagcaggggagcctgctatacatccatgcgtaagtgcaaggattatgatgaggggccggtatacctggacgatacaaagatgacggagcagatctgcctgcgcatgcgggtgaatgggcaggaaggatggcatcccatcgtcgcctggggaacgcactggtacgaggcggacgggcaatgggaagtgattctggaggatacgtccgacatcgagattcatgtggagacgctggcaggcgaagaacttcaagtggagaccatatctttaaaaggcctgccggagcggcgggactattccctgcgccttcagatagaagcgctgtttatggatgagcgtacctgcaagctgacgttcaaggatgtagggttcggagagttctatcctccgacaggatttcaggtggaaaaggtattacatttaggaggaatcaatgggcagtttaattctatgtcataagaagcgcgccaaacaaccctatgagatatccagggttcatatgagaatatatacgatagaggagttatgttactatatctgcaataacctctatcttattgattatacgattattaacaggcagctgtgcgactggatcggggatgaactggaactatccggacttgcggagacgctgcgggaagaattgcgtcagaactgctctatggagcagttcgtgctgaccatattgaaggaatctaccatatatgcagccgcggacatcaaccggatccagaatattctggaacatctgcagaatcagaaggatgtggaaaggacgaagtataaggcggatagcctgcagggcagcggcgagtatgagactgccatactggtgtaccagtccatcatcaacaaagaatgggatgattctgtggaaaagactttctatgggcatgtgtatgcctgccttggagcagcctatggacacctgttcctgtatgaagaggcggcccgcatgtatcaggaagcttaccgcatctgcgaggagccggatatgctcaaatcctatctctactgctgctttagggcattgcctgaggcgcagtacgtgaagatgctttccggcaatccgatctatctgagtatggattccgtcctccgggaagagattaagaaggcgcgccaggaagtggacatcgatatgccggaagaacagttcctgaaatggaaaaagcagtatcgcaggattgacaaaagccggggaatatgctaatataacagagcaatttagtgtggtaaagtaatcaattgataacatgataaaagagtacagtgattgcgattccacaatactgtaatacaggaggaaaaggtatgaagaagagagcagcattgctgcttgcccttgccatgctggcgacaacggttctggcaggctgcggcagcaaggaagacaagagcgcagacaacaagaaggaagataagaaagaggcaaaggtcgagaacgatgacgagaccttgatcgtgggattcgacgcttccttcccgccatatggatataaggatgacgatggcgaatatgtcggatttgacctggaacttgcacaggaagtatgcgacagaaacgactggaagcttgtaaagcagccggttgactgggatgccaaggatatggagattgattccggaaccatcgactgtatctggaacggtttcaccatgaacggccgcgaggacgagtatacctggtcagacccatatatcgacaacaagcaggtgatggttgttgcaacagattccggtatcaatagttttgatgacctctctggaaaactggttgagacccaggcagattcatccgcattggcagcccttcagggagaccagaagaaactggcagatacatttggaagcctgacagagattgcggaatacaatacagcgttcatggatctggaatccggcgcgtgcgacgcgatcgcaatggatatcggcgttgcatactaccagattaattccaggaagaatccggatgattacaaggtacttgacgaagagatctcttctgagcagtatgctgtaggattcaaacttgggaatgaagaattgagagacaaagtccaggccacattagatgagatggcggaagacggaacagttgcaaagattgcagagaagtatgaagattttggagtgccaggatccctctgcatcggaaagaaatagtaaatacgtgaatgactggcaggggtcagccccagataaaagggactggctcctttgccgcgtcttttgagaagttggaggagaacctgatggattttggaacgcttattagagagttgagcagcggtatgctgatatcgattgaaatatttgtgctgactctggtattttcattgcctcttggcctggtggtggcattcggaaggatgtcgaagatcaagccggtccaatggctcgctaagatatacatatcaattatgagagggacgccgctgatgctgcagctgatggtcgtttattttgggccgtactatattttcggaatccggatttccagcacctatcgcatgactgccgtgctgattggatttgcgatcaactatgccgcatactttgcggaaatataccggggcggcatcgagtccatgtccgtgggacagtatgaggcggcaaaagtgctgggatattccaggccacagaccttcttctgcatcatctttccccaggtgatcaagagaatcctgccgtccgtgacgaacgaggttatcacgcttgtcaaggatacttctcttgcgttcgtgctggcagtggccgagatgtttacgatcgcgaagcagattgcggccgcgcagacttccatggtgcctttcgtagccgcgggaatcttctattatgtatttaacctgattgttgcagtcgttatggaagcgctggaaaagaaattgaattactatcgttaggaggacatgccatgagcttgttagagatgaaaaatataaaaaagagctttaacggggtggaagtgctcaaagacatttcccttacggtagaaaagggggaggtgctgggaatcatcgggccttccggctctggaaagtctacgctgcttcggtgcgccacgaacctggagacgccggacgcaggcgagattcactatgaagggacgtttggactggtattccagagttttaatctgttccctcattattccgttatgagaaatatcacggatgcccctatccgcgtacagaaacgtaagaaagagaaagtctataaagaggccagggaactactggccaagatggggctgtcggacaaggaggatgcctatccgtaccagctctcaggaggccagcagcagagggtatccatagcaagggcccttgcgatgaatccggatatcctgttttttgacgagcctacgtcggccctggatccggaacttacaggagagatcctgaaggtaatcaaggatcttgcggcagagcacatgactatggtgatcgttacgcacgagatgaattttgcgcggaacgtatcggatcatatcatttttatggacaatggatacatagccgtccagggaaccccgaatgatgtttttggctcttccaatgaaagaatgcaggagttcttaggaaaatttggtgataattaataaaaggcagaatattgcttttccatctgccttgtattatactaatacgtgcacaacgtgtccgacggacgcgcaaaccagatgataaaattgagaaaaggatgggtgttatcatgcagaaattagaacaattgtatgaaggtaaggcaaaaaaggtctttaagacagatgatccggatattgtaattgtagattataaggatgatgccacagcatttaatggcgagaaaaaaggaacgattgttggaaaaggcgtaatcaacaaccgcatgacaaactacattttccaggtcctggaaaaagagggcgttcctacacattatgtagaagagttaagcgacagggagactgccgtaaagaaagtggagatcgtgccattggaagtgatcgtgcgtaatgtggctgcaggaagtttttccaaaaggctggggattgaagaaggaacaaaattgctggcacctacacttgagttcagttataaggatgatgacttgggagatccattgatcaatgactatatggcaatcgcgattggcgcatctacaagggaagagattgaaaagattacagaatacacctttaaggtgaatgaagtcctgaagaagttctttgccgatgctggaatcgagctgatcgactttaagatcgagtttggaagattccacggcaatgtcattcttgcagacgagatatctccggatacatgcagactgtgggacatcaatacccatgagaagctggataaggaccgtttccgcagggatatggggaatgtagaggacgcgtatcaggaagtattcagcagaatcggcataaagtaaggagttgcattcatgaacaaattggagaaagtgacaaccggtttgggagaagaatgcggcgtatttggagcctatgatatggatgggggcgacgttgccccgtccgtatactatgggctttttgcgttgcagcacagaggacaggaaagttgtggtatcgcggtgacggatacctatggcgagcgcaaggtacatttcaagaagggccttggactggtcaatgaagtcttcgatgaagaatcccttcagacattaaaaggcaacctcggggtgggacacgtccgctattccactgccgggggctccaaagttgaaaatgctatgccgctggttatcaattatgtaaaaggaacgctggcaatcgcacataacggcaatctgaccaatgccatcgaactgcgcagagagttggaatatacgggggcgatctttcagacgaccatagactcggaagtgatcgcctatcatattgcaagagagcgcctgaacgtatcgacggcagaagaggctgtaaaaagagccatgggcaagattaaaggcgcgtatgcgctggtagtaagctcgccccgcaagatgatcggagccagggatccatttggcctgaagccgctgtgtatcggaaagagggaaaatacgtattttctcgcttcggagagctgcgcggtcgcggcggtgggcgcggaatttgtcagagatgtagagccaggcgagattgtgacgattacaaaggatggcatacaatctgatctgtcgatggctattgagccggaaagccaggcaagatgtatctttgaatatatctattttgccaggacggacagtacgattgacaaggtaaacgtgtaccattccagaattattgcaggaaaagcgcttgcacagtcctatccagtcgacgcggatctggtggtgggcgtgccggattcgggcctggtggctgcaaaggggtattcagaacagtcgggcattccttacggaatggcttttcacaagaacagttatgtgggaagaacgttcatcaagcccaagcagagccagcgggaaagcagcgttaagattaagttgaatgtaattgcagaagtcgtaaaggacaagaggatcgtcatggtggatgattccatcgtgcggggaaccacttgtgccaatattataaagatgctgaaaagagcaggcgcgaaagaagttcatgtgcggattagctccccgccgtttctgtatccttgctacttcggcacggatgtaccatccaatgagcagctgatcgcccattcccataccacggaggagatacgggaactgataggggcagattcgctggggtatatggagattgataaattaaagaatatggtgggcagcctgggatactgcgacgcctgctttaccggcaactatcccatggaggtaccgggcagggatgtatcccatgcattcgagtaacatgcccggctttctataaaaaagattaggagaacaatgacgatgacaaatgacagataccaaagccctctttctgagcggtatgcaagcaaggagatgcagtatatcttttccccggacaagaagttccgtacctggagaagactgtggatcgcccttgcacagacagaaaaagaactgggcctgccaatcacggatgaacagattgaagagttgaaagaacatgcagatgatatcaattacgacgtggcaaaggaaagagaaaagattgtccgccacgatgtaatgtcacacgtatatgcttatggacagcagtgcccgaaagcgaaaggaatcatacaccttggggcgacctcctgctatgtgggcgacaatacggatatgatcctgatgtctgaagccctggatattgtcaggaagaaattagtaaatgtaatagcagaacttgcaaaattcgcagatgagtataagggtctgccgacgcttgcgtttacccattttcagccggcacagcctacaacggtgggaaagcgcgctaccttatggatgcaggaattcctgatggatctggaagatctggaatatgtaaagggaagcctgaaacttctgggatcaaagggaacgaccggaacgcaggcaagtttcctggagttattcgatggggatcaggagaccattgacaagattgatccgatgatcgcggagaagatgggatttgaggcctgctatccggtatccggacagacttattcccgcaaagtagataccagagtgctcaatgtccttgcgggaattgcggccagcgctcacaaattctccaatgatatccgcctgcttcagcatttgaaggaagtggaggagccgttcgaaaagacacagattggctcatccgcaatggcatataagagaaaccctatgagaagcgaaagaatcgcgtcgctgtcacgctatgtaatggtggatgccctgaatccggctatcacatccgcgacccagtggttcgaaagaaccctggatgactccgcgaataagcgtctcagcgtgccagaaggctttctggctattgacggcatccttgatctttgcctgaacgtggtggatggcctggtagtatatccgaaggtgattgaaaagcgcctgatgtctgaactcccatttatggcaacagagaatatcatgatggatgcagtgaaggcaggaggagacagacaggaacttcacgaaagaatccgcgaactgtccatggaagcaggcaggaatgtaaaagaaaagggcctggataacaatctgctggaactgatcgctaaagatccggcgtttaacttaagcgaagaagaactgaaaaagaccatggatccaaccaagtatacgggccgtgcctgtgtacaggtagaggcattccttaagaatgtagtcaatcctattctggaagagaacaaggatttgctgggaatgacggcagagattaacgtgtaagggatatctggtgatgcagggcgtgtctggttgaacaggacgtccggccaaagcggcggggagggttccgactcgcttcgcctggtctttgtaacttcaaaagccgccagaatgcggtatggtaattttatctgagataaaattaccataccgcattctggcggctttttcagcaacaaagaccataggcttgctcgacggaatccaccctgccgcttcggccggcctgtggcaggcaattacgcatctgcattatcgggagaaattacagtagaaagacgtgccgtagcgtcagtactaatatagaaattgccaacgaggtgaagggagcgggatggggcgggtgggaaattgcggaggtaagtggaggcgtccggaatatccatgcccgcgatgttagcctgtgaaagaggagtcagccgacgactcttacacaggcttacatcccggtgcgtgagatgtaggcgccgcaacgtcgcagcaatttcccacccgccccatcccgcgttctccacaccccaaatttctacctaaaaaattggaagctttccacaaatttcatcttttaacataacgtaaattcaacatgcaattagcacaattgaagaaatctcaccaaaagtactcaaacgtgcagaatggtattgcaaaaatattgataatattttatcataaacgtatcaaatgatttcaaggaatcatcactgatatctatgagagaaggagggaactattaacatggagacattgaataacattgtcttgacaatccagcattatcttgcggattacattttgatcattgcgcttcttttgggaggcctgtggttttcaatccgtcttggctttatccaggtgaggggatttggcgaaggcatgaggcggacatttgggggactgttccacaagaaaggcgaggcgggagcagacggcatgtcttctttccaggcgctggcgacagcgattgccgcacaagtaggaaccggcaacatcgcgggagcggctacagcgctggcggtaggaggcccgggagccatcttctggatgtggatcgcggctttccttggaatggctacgatcttcgcagaggccatcatggcacagaagtataagcaggtaggaaaagacggtgagattacaggaggacctgtatactatatccgcgctgcattcaaagggacctttggaaaggtgctggctggcatttttgccgttctgatcatcctggcgcttggatttatgggaaatgccgtgcagtctaactctatcgcggcagccttccatacagcatttggtattccgcaggtggctatgggagttattattgccattctggcattgttcgtatttgtaggcggaatgaagcgaatcgcgaaagtaacagagacgatcgttccaatcatggcagccctttacatagttggcgcgctgatcgtaatcatctataactataagaatataccatacgcattccacgcaatcgtagttggcgcattcaacccggcggccatttcaggcggcgctgtcggcgctacgatcaagctggcgctgaccaaaggcgtggcccgcggattgttctccaatgaggcaggtatgggctcgacaccgcatgcccacgcggtggcaaaggtagatcatccggttgagcagggatttgtcgccatggtaggcgtatttatcgatacattcattgtgctgaacctgactgcccttgtgatcatcacgaccaagtcaatccctaccggcaagacgggagcggaactgagtcagtacgcattctcgacactgtatgggaagggcggagacatctttattgcggtatgcatgttcttcttcgcgttctctacgatcataggctggtatttctttggccaggccaatgtgaaatatttgttcggacctaaggcagtcaaagtatattctgttctcgtggccggatgcgtagtactcggatcacttgcacaggttgaccttgtatggaacatggcagactgcttcaactctatgatggtattgccgaatatcctggcattgttcgccctgagcggcatgatcaagaaggtgcacgacgattactatcaaaactttttgagaaataagaaaaagtaatattgcataaaaatccacctagaaatttatggaaaacaactaaaataagtttgattttcctttcaggttgcaaaaaatttaacgataggttattatagggataggcgataggttatattcacattgtctataagtaaaattgaaaagtgggatgatgtttctcaagagagagttggaatatccagccgccgaagaggcaagccgggcgtgtgatggtgagcgcatgcaaggtgaaactttcaggcaaaaggactgggaaacgtaccacattctgaatcttgtgctgtatggtaaagcgtattttttaaaacatattatcagggcaaaagacagaaaggacgatatatacacaagatgtgtttaaatcgtccttttttagtgggcttaaaaacctaacgaaaatgtaccgaaaggagaaggtggatccgatgagtcagggcaattatttcataataaccaataatccactggttttagaaaagcttggcgagacgcacaatgtaatatatcaagagatttcctatgaagaggttcttaaggaagtcagagacagaatccacgaagggcacttgcttttatcacatcccttatccggaagtgtgaagcctaatgaaacaccatacaaatcagttatgctgtcaaagggaaagggggagatggacgaaaggtcattgtcgattattgaaaatgccatacaggcctgcggcaagttccaattcaggtcggacaagtacaagcctgaggtatacgcggactttcagctgattgactggaccttgatagaaagtggattggcatcggcagatgcttggtaggtctttttgagagaggttgtaaagcattgcagcttaaacaatattaatattcttttgaaggagggaatcacaagtgagattagaaatgggacacatttacattaaggatatccagtttgcttcagagtccaagattgaagacggaatcctctatgtatccgaagaagccgctaaggcggttgctcttgaagacgagaagatcaagagcgtatcatttgacattgcaaagccaggagaatcagtaagaatcacgccggttaaagacgttattgagccacgagtgaaagttgaaggaagagggggaatcttcccgggcgttatctcaaaggttgatacggtaggcgaaggaaagacatatgcattaaagggaatggctgtagtaacagcaggaagaatcgtaggattccaggaaggaatcatcgatatgaccggtcctggagcagactacactccattttccaagacgctcaacctggttatggtatgcgagccggttgatggaatcaaacagcatgattacgagaaggccgtaagattcgcaggattcagagttgctgcctatattggggaattggcacgtgacctgacgcctgacgagacgaaggtatatgagacatgcacgatcaaggaaggccttgagaaatatccggaacttccaagggttgcatatgtacagatgcttcagagccagggacttctgcatgatacatacgtatatggcgtagacgctaagaagattgttcctaccattttaagcccaacggaagttatggatggagccatcgtatccggtaactgcgtatccgcgtgcgacaagaacccgacttatgtacatctgaataatccggttgttgaagacttattcgaacagcacggaaagacattgaactttgtatgccacattatcaccaacgagaatgtttatctggcagacaagcagcgttcatccgactggacagcaaaactctgcaagatgttagatcttgatggagccatcgtatctcaggaaggattcggcaatccggatacggacctgatcatgaactgcaagaagatcgaggcagaaggcgttaagaccgtcatcattacagacgagtatgctggacgcgatggaaaatcccagtcactggcagatgcagatgcggcggcagatgcagttgtaaccggcggtaatgcaaatcaggtaattatcctgccgaaacttgataaagtcattggaaccctggactatgttacaaagattgcaggcgcaagcgaggagacccttcgcgaagacggctccctggaagtcgagcttcaggtacttacaggtgcaacaaacgagactggtttcaataaactgagcgcgagataaggaagggaggataagataatggctaaaattaaagttgttcattacatcaatcagttctttgcacagattggtggagaagaaaaggcagattatccggcagaacttcgcgtgggcgaggtagttggaccgggtatggcgcttatggcaagttttaaagacgaggcagagatcatcgctacgatcgtatgcggagactcttatttcaatgagaatctggacaaggcaaaagcagatgtccttgcaatggtaaaggagcagaatcctgacatattcgtagcagggcctgcatttaacgcgggacgctatggcgttgcctgcgcgacgatcgcggcagcggtacaggaagaactgggaattccagcagtaactggaatgtatgttgagaaccctggcgcagatatgttcaaggataaggtatatatcgtatctaccaagaacagcgcggcaggcatgagggatgccgtaagcaagatggcgcctctgacactgaagatcgcaaaaggagagccgatcggcgcttccgctgaagaagggtatatcccgaacggcgtacgcgtgaacttcttcgagaaggagagaggatctaagagagcagtcaagatgctgctcaacaagttaaatgacaagccgtataccacagagtatccgatgccagacttcgacagagttgatccgaatccggcagtcaaagatctcgcgcatgcaaagatcgcactggttacttccggcggaatcgttccgaagggcaatccggatcacatcgaaagttccagcgcttcccactacggagagtatgatatcgcaggcgttatggatctgacagaagagacctacgagaccgctcacggcggatacgacccggtatacgcgaacgaggattctgaccgcgtgctgccagtagacgttctgcgcgacatggagaaggaaggaatcattggagaactgcatcacctgttctacaccacgacaggaaacggtacagccgttgcatccgcaaaggcatttgccgctgaattttctgccaagcttaaggccgacggagtagacgcagtaatcctcacctctacttgaggtacctgtactcgttgcggtgcaacgatggtaaaagaagtagagagagcaggaatccctgtcgtacacatctgtacagtaacgcctatctctatgacagtaggcgcgaacagaatcgttccggctatcgcaattccacatcctcttggcaatccggctctggataaagacgaggagaaagaacttcgccgccacatcgttgaaaaggcattgaaggccttgacaacagaagtagacggacagacaattttcgactagtatataggtgaaggagaataacagaaaatgagcaagatatatgacgttattatcctgggtgcaggtcctgccggcttagcggcagggctgtacgcaggcagaagccgtctttccacgctgatcattgaaaaaggccaggacggcggacagattgcgatcacagatgagattgagaactatccgggacagatcgtagaaggcgagtccggcccatccctgatcgcaagaatgacacagcaggcagagaagttcggcgcagagcgcgtgtccgatacgatcaaggaagtacagctggatggcgatgtaaaggtattaaagagcgaaaagaacgaataccagggcaagaatgtcatcatcgcgacaggagcatattcaaggccgattggatgcaagggcgaggcagagttcatgggcaagggcgtatcttactgcgctacctgtgatgcgaacttctttgaagatttcgaagtatacgttgttggcggcggagattccgcggtggaagaagcaatgtatctgacgaaattcgcaagaaaggtaaccatcatccacagacggaatgaacttcgtgccgcaaaatccattcaggaaaaggcatttgcaaatccgaagatcgatttcttctgggattccgttgtagaggaagtctatggagatgacattcttcagggaatgatcgtaaagaatgtcaagacaggcgagacgagaaaggtcgaggctgatccggaagatggcatgttcggcttgtttggattcatcggaacggttccgaattccaaactgttcgaaggcatcatcgatatggacgaaagagggtatattaagacggatgaagatatgcacaccaatatcccgggcgtttacgcagccggagatgtgcgcatcaagagtctgagacaggttgtgactgcagcggccgatggagcaattgcagcagtacaggtagaaagaagcatgtcagattatttttaaggaggatgttaccatgttagatttaacgaaggaaaactttgaggaagaagtattaaaggcagaaggatatgtattcgtagacttctacggagacggatgcgtgccatgccaggcattgatgccaaaggtacatgaatttgctgatacctatggagataagatgaaattcacatccctgaatacgacaaaggcacgccgtcttgcaatcgcacagaaggttctgggccttcctgttatggctatctataaggatggagccaaggttgaggaagtagtaaaggatgacgctactccagaaaatattgaagcgatgattaagaaatacatctaaaggatgatttctgaatcatagataaacaacatgtttaccacattagaaaggagaaagcataattatggctattttagaaggcaaaaaagcaataattatcggagaccgtgatggaattccaggccctgcaatcgctgagtgcgtgaaaactgctggcgctgagatcgtattttcatccacggaatgtttcgtctgaacgagcgcaggcgcaatggacttagagaatcagaagagagttaaagaattcgcagaagagtatggtgcagagaacttagtagtagttcttggtgcagcagaaggcgaagctgcaggacttgcagctgagactgttactttaggcgatccaactttcgcaggtccattgacaggggtccagcttggactcgcggtatatcacgtatgtgaacctgagatcaaagaagaatttgacgaagcagtttatgatgagcagatcagcatgatggaaatggttcttgatgtagatgacatcgtatcagagatgacagcaatcagagaccaggttgagcaggcttaagtaagccgcgtcaggcaattgaggaggggcaggccacgcgtacccgctaagggtctgtcccttttcttatgaatgagctgaagaaaggtggcaaaccaatgaatagtgtaatcaaaggagcaagctacgtattagtacatactcctgatatggttttatataatggaacaacccagacaacagaaagaattgtgaatccggattccgaatatctgaaagaagtgccgaagcatctgcgctcttatgaggatgcggtagcctattggccgaatcagacatacatcggcaatgttcacccggacgaactgtcagaggtagagttcccatggtatgataagaaaaaggaaggcgcccagcgctatggaaaatatggcgagattatgccggaggaagagttcctcttcctggtacaggccagtgacatgttcgaagtagtaaaactggacaaagaatttgtagcaaagtataaagacgcatttgccaagaatccgatcatctctgaagacatcgtcgagaagattacggatggagtggaacttgccgagatcgagcatctgatggcagacgaccatgcagaagggctctattttgaagataagctggtaggctgcgtgaagcctgcgcacgatatcgacgtgaatttatccgctcatgtaatgcacgagaacctgatgagcaaggcatccagcgttctttctattctttatgcggtacgcaacgcgggaattgacaaggcagacgtagaatacgtgatcgactgcgcagaggaagcttgcggcgatatgaaccagcgcggcggcggtaactttgcaaaagcagcggccgagatcgcaggcctggtaagcgcatccggatctgacgcaagaggattctgcgcggctcctacccatgcgattattgaagcggctgcactggttaagtccggcgcttataagacggttatcgttacagctggcggatgtactgccaaacttggaatgaacggcaaggatcacatcaagaaagggcttccaatcctggaagactgccttggcggatttgccgtagttatctctgagaatgacggcgtaagccctgagatcgacttaggcatgcttggacgccactgcgtaggaacaggatctgcgccgcaggcagttatcggaagcctggtatcagatccgcttgacagagtcggaatgaagcttacggatatcgacaagtattcaccggaaatgcagaatccggatatcacgaagccagcaggagcaggagatgttccgatggctaactataagatgattgcagcgcttgcagtaaaacgtggcgagcttgacaggaaagaactggccaactttacgaaggagcatggccttaccggatgggctccgacacagggacacattccgtcaggagtgccttatgtaggatttgcctgcgaagatattaaggaaggcaagattaagaacgctatgattatcggaaagggaagtctgttcttaggacgtatgacgaacctgtttgacggcgtttcctttgtaatccacggtaacacagctgcacaggaagaagcagcagccggagtatccgaagaagaagtcaagggactgattgccaaggctatgaaagactttgcttctaccctgatggcagagtaaggggtggtgactatggcaaataatattgaaaagatgattgccaccacgttcatggagatggcagaaggcctggagacaggaagtttcggcaagaggccgaagatcgccctcactggcatgggcagcgagcacggggaagcgaacgccatggaagcggcagttgccgcggcaaaagaggggattgacgtatactacatcggtacattggaggccgagggagtaacgacggtcaaagtggctaatgatgaagaaggccacaagaagatggaagaacttctgaagaataaggaagtggacggtgcggtcaccatgcatttcccattcccgattggcgtatccactgtggggcgtgcgattacgccagctaagggaaaagagatgtatgtggcaaccaccacaggcacttccagcgctgaccgtatcgagggcatgatcaagaatgccatctacggaatcatcgcagctaaggcttgcggcaatgcggacccgacggtaggcatcctgaatgtagacggagcacgccagacggagatcgcgttaaagcagttgaaagaaaacggttatgacattacatttgcggagtcggcaagagcagacggaggatgcgtcatgagaggaaacgatgtccttcagggctctccggacatcatggtatgtgattcactgtcaggaaacatcttgataaaaatgctgtcttcctatacgacaggaggaagcttcgaggcatccggatatggatatggcccgggaatcggcgaaggctatgaccagctggtcatgattgtatcccgtgcttccggcgcgccgctgattgctggagcaatccgctatgcggcacagctggtaagaggcaagatattcgaagttgcaaagaaggaattcgaggctgccaacaaggcaggccttaaagatatccttgcagcgagaaaggctgccgataagccggctgcagcgcaggaagaagtaacagcgcctccgaaggaggtagtaacctcgcagatcgcaggaatcgagatcatggatctggaagacggcgtaaaagccctctggaagatcggcgtctatgcagagagtggtatgggctgcacaggaccgattatcctggtatctgacgcgaatcttgcaaaggcagaagaagaactgaaaaaggcaggatatattaattagcatttattcggtgataacaccagattgtttaaggaaagtggcgtcttgaggtgtcaagatgccactttcttttatctccttatggttttataataaaaccgtgaggtattaagagaatggaagcagttataaaaatgacggttccggcagcaaggacccacgttcgctggaggcagattgcggacggagtcttgcttgctggagtattagcgaccctatatatctatgcaagggttcagggattgacatatgcggagatgtcgggaggcgctggaaatggatatgaaatattggatgcaggaatgtcgatgcctgtgcaggcacttccggattcggcgataggagtgatcgatatctcagggcttggaggtttgattgcggttagaaaaagtatggaggaggctcccgtgtccgtggacgaggacagtcaggcgctgccttttgcgacctcaataccggacatagccttgcagatgccggaggcagacttgaccgatggtggcaaaggggaggaagatgatgtacccataacggctttggcggtatccgtatatggcaatggtggcattccggaacttaccacatttacggtggagccagagaacttcgatgcagcgtcccttgagattccaagaaggcttggaaaggaatttgacggatggtatctggatgctgcctgcacaaagccctttgatgggctggcagagaatcagaaggcattagaattgtatgctggatggaaagaattcgacggatttatctgcaatgacaagggacacattacagattatacggatctgtccgtggcaacggatggaattctggcattcccaaggagcccggattgcacaggaatagagtatggctctttggaaggcctggaagatattgtgatggaagtctacatctataccaatattacttatatcgcgccggaaacctttgatcatctgtactttctgatgtacatcgaagtggcgccagggaatcctaattactacagcaaggacggaattttatattcttcctcaggggaactggtggcttatcccaacgggaggaatctatagagggcaggatctttagcagtttgaaaggtcctgccctaaaactttacaaaaatatactataatttttggaatgccggtgctataataaattggattaaatttttacagggagcaggctatgaatattcaactgataaccgaaggcaaaaaagactatatggatatgctgctgctggcggacccacaggaggatatgattgagaaatatcttggtaaaggagagatgttcattctaatagatcagggcgaggtccggacagtctgtgtcgtagaactgctgaaaaacaggaaatgcgagctgaaaaatatcgcgaccagggaaggcgaccagggaaaaggctatggaaagtatatgatccattttatctgcgagcattacagcaaccgatgcgataccatgtatgtaggtacagggaactgcgcaaagtctattggattctatgaaaagtgcggatttgccaattcccatattgtggctaatttttttacggataactaccgggagccgatctatgaagacggggtccttcttacggatatggtgtacctgaagaaaagcctggattctgagatagacgtaaagaaagtggtagatattgccctggaggcaggaaggatcctgcttaagaatggcgctgagatattccgcgtggaagagacaattaccagaatctgccaccggttccatgtggagcatgtagatatatttaccttaagccatggtatcttcattagcgcggagaacggcctggaagaagcctatacgaaggtgaagcatgttccgctgtccgcgcctcatcttggcattgtggcagaggttaatgatctatccagggagatctcgagcggatacgtaagtatggaagaggcggtagagagactgaaagagattgaccggataccgcccaaaaaggattatttccagattctggcggcaggagtcggaagcggctttttcggatatcttcttggagcgacggcgctggaaagcatgatcgccttttgcatagggtgcatactgtacatgtgggtgctggcagggaaaaagcacaatatgtcaaagatcattattaatattgtaggcggcgtgatcatcacggcccttgccatctgtgccaagcatgtaccgatttttggcgaggtgaagatggaggggatgattatcggatccatcatgcccctggtaccgggagtggcatttgtcaatgccatccgggatattgcggacagtgatttcctgtcgggcacggtgcgcatgatcgatgccattctggtcttcgtctatatcgccatcggggtcggctttaccttaagcgtatataataacatgatcggagggctggtattatgatgcatgagtttatgataaatatagtctgccctttcatgggaaccatgggatatgccgtgctgttcaatgtccccagacgcttttacttaagctgcgggatgacgggaaccgcaggctggctggtattcaaggcaatgcagggatacgcttccgcggcggttgcgtcttttctgggggctttggtagtggtgctgatatcccggatgcttacggttaagatgaagtgcccgatcaccatcttcctggtatcaggaatctttccgctggtgccgggcgccggcatctattatacggcctactatctggtgaccaaccagctggcgctggcggcgcagaaaggcctggaatcggtgaagatcgcgtttggcatcgtgcttggaatcgtattcatcgtatccattccaagagaagcattccaaatcaagtattggaggcaaagaaggcttagaaaaggttgatgtaggcgaagcggatgtgctacaatatgtttacaatccagagagaaagctggggttgattacagcaagaaggagggtgagcatatgttaggaaagacgttagtgcagatactaaaggaaagcaagtataccacggtcttaagcggagttgggatgctgcaggaaagcgaatatccggcgataagagatggcgaagagtcctatgatatcgagtcaagatacggatattccattgaagagatgttttccagttccttttactccacgaggaaagaacagttctacgagttctaccgcaatgaattgctgagtaccttggataggccgccggggaagtgcttttatgagatggcagagctggagcgcagaggaatgttccaatccatcatcacgagaaggatctgcggccttcccacaagagccggatgcaagaatgtaatcgaactgcatggaaatgtatttgataattactgcccgcactgcggacggaagtattccatggaattcgtcagggataccgggaaagtacctctgtgcgaggcgtgcaagacgccggtgcggccgaatgtatgtctgtttggcgagatggtagacaaccggatcatgacaagagcggcagaagaagtacaaagagccgatgtgctgctggtgctgggaaccaacctgaagtcctatctatgcacccagctggtaaaatactatgacggagataaactggtgctggtcaatgcggtaccccatttctccgatcggcttgccgatatttccattaatgacagggtggataatactttggaaaaaatattaaaagaattaggagactgacatgagcaaggtaagaacaagatttgcaccaagccccacagggaggatgcatgtaggaaacttaagaacagcgctttatgcttatctgatcgcaaagcatgagggcggagattttatgctgagaatcgaagacacggatcaggaacgctttgtggatggagcgttggagattatttatcatacattggaagagacagggcttatccatgatgaaggcccggataaggatggcggcgtaggcccttacgtacagagcgagaggaatgcttccggcctgtatctgcagtatgcgaagcagctgatcgatcagggggatgcctattattgcttctgcgacaaggagaggctggactctttaaagagcaaggtatctgaagatggcggtacggagatcgtggtctatgacaagcattgcctgggacttagcaaggaagaagtcgaagccaatctggcggcaggcaagccttatgtcatacgattcaatatgccgacagagggtaccaccacattccatgacgagatctatggcgatatctctgttcccaacgaggaattggatgatctgatactgatcaagtcagacggatatccgacgtacaattttgccaatgtaatcgatgaccatctgatgggaatcacccatgtggtcaggggaaatgaatacctgtcctctgctcccaagtataataagatctatgaggcatttggctgggaggttccggtatacgtgcactgcccgctgattacggatgagaaccacaagaagttaagcaagcgctgcgggcactcttcctacgaggatctgatcgatcagggattcgtcaaggaggcagtggtaaactatgtagctctgctgggctggtgcccttccgacaatcaggagatattctctcttgaggaactggtgaaggcgttcgactaccgtcatatgagcaagtcgcctgccgtgttcgatgtcgtgaaactgaaatggatgaatggagaatatctgaaagccatggattttgacaggttctatggcatggcagagccttatatcaaggaagtggttacaaagtcttatgaccttaggaagatcgcgtcccttgtaaaaacgagaattgagatattcccggatatccgggaacagatcgatttctttgaggaactgccggagtatgacatatccatgtattgtcacaagaagatgaagaccaatgaagaaaactctctggaagtattaaaagatgtgcttgacattctaaaaggccaggatgacttcagcaatgacgggctgtttgcggctttgaaaggatacgtggatgaaaaaggctataagaccggatttgtgatgtggccggtaagaaccgcggtatccggcaagcagaacactcctggaggagcaacggagattatggagattctcggcaaagaggaatctcttgcacgtatcagaagaggcattgaattattaagcaagtaaggggaatctatgagtttaaatcatgctcaggcagaggcagtcgcccacaaggaaggaccttgcatggtcctcgccggtcccggttccgggaaaactcttaccatagcaaagagaattgaatacctgataagaaagtacaaggtaaggccagaagagattctggtcattacctttactaagtatgcggcaaaggagatgaaggagcgtaccaggaggcttcttggcgaggaagcgcagccagttaccttcggtaccttccatggcatctattatggcatactgaaatgggcatatagcctgaatcaggcaaatctgctgacggaagaggaaaaatacggcctgatcaggcaggctgcggcgaagatagagtgggaagaactggaagatgccagtgaagaaaaagaaaatctacaggatctggctatagagattggcaatgtaaagaacaactgcctggatattaagacctatgaatccatacgattcggggcaggaccgttccgggaattataccaggcctatgaagaggcgaagcaaagacttcgcaagctagactttgaagacatgctgctgatgtgcagggacctctttttaaaaaggcgggatatcctcgaaaagtggcagcaaaagttccgctatatattggtggatgaattccaggatgtgaaccaggcccagtatgacgtgatccgcatgcttgcggcgccggaagacaatctgtttatcgtaggggatgatgaccagtccatctatgggttccggggggcaaagccaggcattatgatggagtttgcaaatgattatccgaatgccagacagattcttctgaatgtgaattaccggtccagcgctcacattgtcaatggcgcgctgcgggtgatcggacataataagaccaggtttgacaaggagatcgcagccaagcagaaggccggagaaactatccatgtacaagaagtaaaagatccggtagaagaaagcagatatgtgctggagcggatacaggaatatcaaagccagggaatcccatatagccagatggccgtgctgtaccgtaccagcctggatgccaggatgctgtcagagactttgatggagtatcaggttccatttacgatgaaagagcacttgaataatatctacgagcattttatcggaacggatatcagtagttattttcatctggctaagggagagcaggaacgcaaatatttccttcagatcgccaaccgtcctaaccggtatatcggacgtgacagcatgagcgaaagcaaggtcacttatgagactctgcggaatttttactgtgacaaggcgtggatgcagaaccgcattgaccagctggagtgggatatgaagatgatctgtaataagacgccatatgcggccatccagtatatccgaaaaagtatgggatatgacgaatacctgcgtgaatacgccgcgtatcggcaggtgcagccggaagaactgatggcagtcctggaagagatccagcagaattccaaagagtatcagagtattgacgaatggttcgagcacgtggaaagatacaaggaaatgctggcagagcaggcaagaaaatcccgcagccaggaaggggagggcgtggcgctgatgaccatgcatggcgtaaaggggctggaatacgacacggttttcatcatacagggaaatgaaggaagcattccgtataaaaaggcaaagtcgtcggatgacatcgaagaagagagaaggctgttctatgtggctatgacgcgggccaagagaaagcttatcataagttatgtaaaagaaaaaaacgggaaaagcctaagcccttcccgctttgtaaacgaactattcatcgtcgcctgattcttcgaattcctgggtatccatccattcgtcgaaagcatcggcagcgatctcatattcatcgtcatcttcgatattctcaagttcaggctcgccgtcggcatcttccgtatagcggtaaagatatacgtctccgtcctcggtctccccgtcttcattcagaggaaggagggcgatatattccttgccgcctgcctcaaataaagtgaggatcgcgcattcaacgacttcatcgttatcaagtgtcagttccacggtcatgtattcgtccatagtagtactctcctttgcataataatactttaactgtaccaaaggaacctgcaaaaagcaaggggaaatgaaaagagtagccaaaacagtaaaaatgttgtaaaatgtacctgtgcgtgtaaaacaatgcataaggaggaagactattatgatgaaaaagagaatgttaggagtattggctttaatgctcgtatgcattttcgctttgtctggatgtaaaaagaacgtgggtaccccggaggataatgcggtgaaggaagactcgcaggatggcgaagatgcagaagaggaagaagatacatattcatttggcttttcagccatagacatggagaatccatattttattaccctggaggctgcaacaagggaagcgatcgagaaggaaggataccggatgatcaccaaggatccggcaacagatccagacttgcaggcggcgcagatccaggagatgattgatgaggggatcgacgcgatcttcctgtgcccggtggactgggaggcgatcacgccgtccctgaaggcgcttaaggacgcggatgtgaagatcatcaacgtggatgcccaggtaaaagagatggaatatgtggacgcctacattggctccgacaatcagaacgcaggctatatctgcggcgaggatctgatcgagaaggccccggatggagggaaggtggcaatccttgaatgcccgacccagaattccatcaatgacaggattaccgggtttgaagaagccatatccaaagcagagaagggctttgaggtagtggcaagagaagataccaagggagagtttgacaaggctctggaagcagccaaatcaattcttgcagaatatccggatgtgaccgccatcatgtgcggcaatgaccagctggcggtagccgccaagacagcggtgaacctggcgggccttgacaaagtgatgatctatggggtggacggctccccggatattaagaaggaactgaagaagccggaaacccagattgcgggaacagcggcgcaatcgccgattaatattggaaagaaagcctctgaggttgccatcagcatattggatggggatgactatgagaaggagacttatgaagaagtattcatgatcaataaagacaatgtggacatgtatggaaccgacggatggcaataatcataaacggacgacaggaaggattaggcatgaaagagatagaggggcggcccttgccgttaggcgttacaatttcagaagatgaggtgaatttttccgtggctgtgccggagggaaaagaatgccggctattgctgtaccgggcaggggagagcgagccttgcgcggcctatccgatggatatggctgtaggggaagtgcgttatcttgcccttaaggggcttgcgccatccgattatgagtataattatatgatcgacggagaagtcgtggcagatccctatgcgaaagcgcttgcaggcagggaagtgtggggcaggaaaagagagatgcagaaccatgaagtccgcgggatcctctatgccagggaatatgactgggagggagacaggcccctgaggcttccataccacagagtgattgcctacagcctgcatgtgcgtgggtttacaaagcatttttcttcccaggtaaagaataaaggaacatttctcggcgtagtagaaaagattccttatcttacagaactggggattaaccagattcatctgatgccggtatatgattttgaagaatgcctgcaatacaggaattactggggatacggggatgcctactgctttgcgccaaaggcgtcgtattccgcatccggcgatgctgtccgggaattgaaggatatggtgaaggcctgccataaggcaggaatagaagtcgtgctggagatgccttttactgggacagtccccaagcagatgatcgaagagtgcctgcggtattacatgatggaataccatgtggacggattcatcctgaaccctgtggttgcgcccatggaagggatttatgcagatccggttctaaaaaagaccaagatcatggtccatcagctgggcttccagaccgtcatgcgccgtttcctaaaaggggacgagggcatggtgccggaggtcatgcattggcttcggcataattccagagaagaaggaatatttaattatatagcgaaccataatggcttcaccttgtgcgacttggtatcctacgatggcaagcacaacgaagccaatggagagaataaccaggacgggccggactataattttagctggaactgcggggcagaagggcctacaagaaaaaaaggcgttctggaactgcgcgacaggcagatgaagaacgcgttcgcccttgtgctgctggctcaggggacgccctgcattctggcaggcgatgaatttgccaattcccagaaggggaacaataacgtctattgccaggataatctgacgggatggctggactggcggaaactggaacgggaagaggaactttttgcttttgtcaaagggctgatcgccatccgcaaaggatatccggttttctgcccggaggaagaacttcggggaatggatcagacctgctgcggcgtgcctgatgtgtcttatcatggggaaaatgcctggcaggcgccgtcggaagtatccagccgccagctgggcgtgtactatagcggcgcagttcttgaaggagaggattgctttgtggcctacaatatgcattggctgaagcatacatttgctctgcccgcgctgccaaaaggaaagaaatggtatcagattgcctctacagaagatggaattcttaagaaggcggaattgcttaaaaatcaaagaagcgtagaactggacgaacggacagtaatgatgctcgcaggcaggtaagggacatggctaatagcacggaaggcatgaattggaaggctggaattacttcatatcagttgaaatggattgccatcgtgacgatggtcattgatcatatgggggcaatcctgtatcctacagagatggcattccgatatatagggaggctttcctttcctatattctgctttcttctgatagaagggttcttccatacccgcaatatcttcaagtatatggcaaggctgggcgcatttgcgctcatatcggagattccttacgatctggcttttaagggaaaagtgttggaattcacgcatcagaacgtattctttacgctttttctgggagtgcttatgatgtatgtcctggaaaaaggcggagaatggccgcagaaggctgttgaggtcctgctggtcatgtggctggcggagatgctccataccgactatggattcaggggaatcctgctggcattcatattctacaagttacggaacttccgatggacgaaacttggatgcggggcggcctggaatctgatctggaaccgaagcatacagggatatggcgcatttgccatgatcccgatcgcattatataatggaagccggggcagaaagatgaagtatttcttctatatcttttatccggcccatcttttgattttgtttgttattagcagatatataggataacagggaaagaaaaaggagtaagtatgaaagtttggcagcatttgcgcacgattaatcatcataaatcactggtcatgaagcattgctttaaagttgggctttataaacagggactgcttcacgacatgtcgaagtattcgcccacagaatttctggtgggatgcaggtattatcaagggaccaggagcccgaataacgccgagagggaggcgacaggctattccaaagcctggctgcatcacaagggaaggaataagcatcattatgagtactggattgattacagcgtcgatccgggagaaggcatcgtgggtcagaagatgcccataaaatatgtaatcgagatgttcatggaccgggtggcagcatctaagacttatcagggcagcaattataccgaccggcagccgctggagtattatgaaaaaggagcagccaagcttggcaagatgatacacccggagacagcagcattgcttcactttttattgaagatgctggcggaggaaggggaggaaaaaaccttccgatatatccggagaaatattttaaaaaattacaattaattattgacattttaggccctatatagtaatatattcttcggacggttcaagcgtcacttgcggaagtgtcggaactggcagacgagcaagactaaggatcttgtgagcaatgcgctcgtgtgggttcaagtcccatcttccgcagttaacacccctaatttactggatttccggtagattaggggatttttgtattatctttttgtattcccctggccacagccggccattctttaaagttccttttcgccataatccgcatatattgtaataaaacgattggtggtaacatgttatgaataatgatcctcgtggcactatgatccagcagggaaacacgatgcggataaataatggctttgtggaagacgtatcctgttttaataatgcgagagggcaaatccttgtttcttatgccgtgcgggaaagaaacaatataacttccatccaggatatccagctgaatattaacagaggcactgtgatcctgaattcttttgggcagcgtatgtgcctgtgctgcattcaggcaggatcctgggtaaatgctacattttccgcacgtatgacaagaagcattccgcctcaggcaaatgcgttcctggttaccgttctaagaagccccaggccttcgtcctcggttacgataggcaggattatcatgattgattttgacaataactttctgattacggaagatcctgacaacagtgacaatcagatgaagtttatcattacaaatacgacttcatttaccagccgttttggggcgccgatcagattcagctcgctctggccaggccaaatggttcgcataacccatgctaacttccagacaccaagcattccgcctcagactacggcattcaatgtccagttaatataagatgaagacgaataattctgtatttaattaaaaatactcaatttattgcgtatatggtgtataatgggcataagaatcagaaaacctaaagagcagggagggaatgcctatgctggagaaactggatttaacgaagacgcttagcaagtcggagtataaagagaagattatggaactggagccgaagatcgggaaactccaaagggaatgcaaggacctggggattccggtcatgatagcatttgagggatatgacgcagccggcaagggcgttcagatcggagaattgataaaggctctggatccaagaggatttgaagtacatgcggttaagaaggagacggaggaagagcagatgcatccattcctctggagattctggaccaagatgccgccaaagggacggattgccatatatgacagcagctggtaccgcaaagtgctgattgaccggtttgacaaaaagaccaagaagaaagaagtggcggatgcttaccggtctatctgctctttcgaagaacagctgacggatgatggaatggtaatcataaagatattcctggcgatcgacaaaaaggagcagaaaaaacgttttgaaaaacttttaagttccaaggagacgtcctggcgcgtaagcgagggcgacttgaagcgtaataaggagtttgacgagtatgaggcgatcaatgaagagatgctgatgcgcacggacacggagcatgcgccctggaacatcgtggaagcggtcgaccgcaggtttgccacggctaagatctatgcgattgtcgcccagacgctggccgggaaggtagaggaagtaagaagaaaggaacgcctggggcagtttaaggaagaggagagtacggaaccagaaaaggagacggttcaggataagaaactgaccgaatccattcttgccaaggcggacttaagcctgtcctattccaaagaagaatatcggaagcggctggagcagctgcagaagaagatggagaagcttcacggagaactgtaccgcaggaggattccggtggtgctgggatttgaaggatgggatgcaggcggcaaaggcggcgccatcaagcggctgacagaaaagatggatccgagaggctatgtagtgcatcccacagcctccccgaatgatatcgaaagggctcatcattatctgtggagattctgggtggatatgccaaaagccgggcatattaccatatttgaccggacctggtacggcagggtcatggtagagcggattgaaggattctgtacgaagcaggagtggcagcgtgcctacaaagagatcaatgatatggagcatgatctggcaagcgcaggcgcgatcgtcttaaaattctggatgcagatagataaagacgagcaggagagaaggtttcgggcaaggcaggagaacccggataagcagtggaagattacggacgaagactggcgtaacagagaaaaatgggaccagtacgaggaggcggtcaatgagatgctgatccgtacttctacgccggacgcgccttggatcgtggtagagggaaactgcaaatactatgccaggatcaaggtgcttcagacggtggttgacgcgatagaggccagattaaaggaagagaagaaaaagaggtaggctatgagaaatcatgaggtgaccagaagacaggatctgctaaaagaggacggctccttaagggagccgggatggtccaggcagctggtgcaaagatatgaccgaagccagataaaggcgccaagattccgcattaaggagtgggattattatctggtgctcaatgaagaatttgccggggcatttaccatatcggatgatgggtatatcggccttcagtccgtatcgcttctgaactttaaagaaggatgggagcatacggagaccatattgaacccgtttcccatgggacggtttggccttccggctacttctgaggagggcaataccgtctacagcgacaaacgactgaagatgagttttacagtagaagatggatccaggcagatccagtgcgagttcctggatttctacaaagggaagccgttcatctgcgatatcaggctggaacagccgcagatggacactatagtgattgccacgccatggaaggaaaagaagacggccttctattataatcagaagattaactgcatgagggcttcgggctatatggaatatgatggtacaagatatacattttccagggatacggattatgggacgctggactggggaaggggcgtttggacctatgacaaccgctggtattgggggtcaggcaacgccacggtcgaggggaagcctttcgggttcaatatcggatatggatttggcgataccagcgctgccagcgagaatatgttattttatgatggcgtctgtcataaactggatgatatcaccttccatatcccaaaagatgattataggaagccctggaagtttacatccagcgacgggcgttttgagatggactttttgccggtgcttgaccgggcagcgaagacgtcggcgcttgtcatcgtgacagaccagcatcaggtatttggcaagatgagcgggagggcggtcctggatgatggaagggtaattgaagtcagggatttgatgtgttttgcagaagatgtacataacaggtattaggagacggatgggagagcagtccaatgacgatcagggaacagttagaacttagggagattgaatatttgagtccttatgcaacgctaagcaaggattcaagaggaagagaccgcgcggaagaagaatgcgatatccgtcccgtcttccagagggaccgggaccggatcctccactgcaaggcgtttcgccggctgaagcagaagacgcaggtattccttcttcccaaaggggatcattacaggaccaggctgacccatacgctggaggtatcccagaacgccaggaccatagccaaggcccttcgtctcaatgaagatctggtggaggcgatcgcgctggggcatgatctggggcatacgcctttcggccatgcgggagagcgggcgcttgacgaggtaagcccgctgggattccagcataacgagcagagcgtaagagtggtggagcgtctggaaaagcagggcgagggattgaacctgacatgggaagtgcgtgacggaatcctgaatcataaatccgcgggtacgccgcatacgctggaaggacagatcgtacgcctgtcggataagattgcctatatcaaccatgatattgacgacgcgatccggggaggcgtgctcaaggaggaagacatccccagacaatatagggagatacttggaaattctaccagagtccgcctggatacgatgatccataatgtgatcatcaacagcatggatcagccggagatccggatgtctccggaggtggagcaggctaccatggcccttcgcgctttcatgtttgaaaatgtgtataagaatccggttgccaaaggcgaggaagaaaaggccattaacatggtgaccaatctctatgaatattaccggaggcatatccagctgcttccggatcagttccttgaaatgctggaggaagaagggggtacgccggagcggattgtctgtgattatattgcgggaatgacggatacatacgcgatcaagaagttcgaggaatattttattccggaatcttggaaaatttaaaggaaatcaagtacttttgtcgaatattatatatgagggtgtaaattatgtattattccgatgaagtaattgaagaagtaagatcaagaaatgatattgtagatgtaatctctggctatgtgaaacttcagaaaaagggaagttcttattttggactctgtccattccataatgagaagtctccctctttttctgtgagccagcagaagcagatgtattactgctttggctgtggggccggcggcaatgtattcacattcctgatggagtatgagaattattccttcgtagaagcgcttaagtatctggcggacagagcaggcgtggaacttccggagcaggaatactcgaaagaagcaaaggcccgtgcggacaccaaggctatcttgctggagatcaacaaggcagccgcacagtatttttacgcacagctaaaaggcagccagggggcccaggcgctctcctatcttaagaaccgggaacttggggatgacaccatcaaggcgtttggcctgggatatgccaacaagtacagcaatgacctctacaaatatcttcgttccaaaggatatcaggatgagatgatcgcaaaggccggactaattaccgtagatgaaaggcagggggcttacgacaagttctggaaccgggtcatgttcccgatcatggatgccaacagccgcgtcataggctttggcggccgtgttatgggagatggaaagcccaaatacctgaactcgccggagaccatgatattcgacaagagccgtaacctctacggcctgaaccgggcgaggagtaccaagaagtcctatttccttctctgtgaaggatatatggatgtgatatcccttcaccaggcgggattcaccaatgcggtcgcttccctgggaacggcgcttacgccgggacatgcatcgctgatcaagcggtatgtgcaggaagtctatcttacatatgacagcgacgaagccggcaccaaggcagcgcttcgggctatcccgattctgagggatgtgggcatcacagccaggatcattcggatggagccctataaagatccggatgagtttatcaagaatctgggagccgaggcttttgaagagcggatcggcaaggcgaggaatggattcatgttcagcctggagattctggagaagaattatgacatgcactctccggaagggaagactgatttcatgaaagaagtcgccaggcggcttgcgcaattcgatgaagagattgagcgcggcaactatatagaagcggtggctggcgcctatcatgtagggtacgaagacctgcgcaagctggtgggcaggatggcgatccagacaggactggccaagcctgtggagaggccgaggagcacccagggcaagaagaaggaaaaggaagatgggattctcaagtcccagaagatactgctgacctggcttacatcagatgaggcggtattccgtcagattgagaagtatatcacgcctgcggatttttcagaaggaatctacaggacggtggcacagctgctttatgagcagtacgagaagcatgacgtgaacccggcaaggatcatgaatcattttacggatgaagaagaacaccgcgaggtagccagcctgttccacacaaagatcaaggaactgacaacggcaaaagagcaggaaaaggcattgcaggaaacggttatccggattaagaatcatagtatagaagaggcgactaagaagctggaccccacggatatcaagggtcttcagcagttgatgaatgcaaaaagggaactacaggaccttcaaaaactgcatatttctattaattaaggataaaatataaacaagcaatgagaggatggacgctacatggaagaaaacacagtgaaattcgaggagaaattaaaagaactggtatctcttggaaaaaagaagaaaagtattctggaattacaggaaatcaatgatttcttctcggatatggaacttgaggccgagcagatggagagagtgttcgaacatctggagtccaataacattgatgtcctgcggatcagcggcgacgaggatgacgatatcgacgatgtggatatcgtcattgcggaagaagacgatgtggacatggaaaagatcgacttgagcgtgccggatggcatcagcattgaggatccggtccgcatgtacctgaaagagattggaaaggttccgcttctgaccgcagaagaagaagtggatctcgcgaaacggatggctgacggcgatgaagaggccaagaagcgtctggcagaggccaatctgcgtctggttgtcagcattgcgaagcgttatgtagggcgcggcatgctgtttctggacctgattcaggaaggcaatctgggcctgatcaaggcggttgaaaagtttgactatcataagggatttaagttcagcacatatgccacatggtggatccgccaggccatcacaagagcgattgcagaccaggcaaggacgattcggattccggtccatatggtggagacgatcaacaagctgatccgcgtgtccagacaattgttgcaggaactaggacgcgagcctacgccggaagagattgcggcgcagctggacatgccggttgagagggtccgggagattctgaagatttcccaggagccggtatctttggagacgcctatcggcgaggaagaagacagtcatctgggagactttatacaggacgacaatgtaccagtgccagcggaagcggctgcacagacgctgttaaaggagcagctggatgaggttctggacacattgacggaaagagagcagaaggtattgcggctgcggttcggaatgaatgacgggcgcgcccgtaccctggaagaggttggaaaggaattcgacgtaacccgcgagcgtatccgccagattgaggcgaaggcgctgcgcaagctcagacaccccagccgtagtagaaaattgagagattatctggattaagaaagaggcgcctatggaactatcaaaaagacttaccaaagttgcaagtcttgtgacagagggcgcctctgttgcagatattggaacggatcacggctatattcccatctatctgatcgagaacaatatagccgcaagggcgattgccctggatatcaataaagggcctctggagagggccagaatgcatattgtgggccacgggctgaaaggacagatcgagacccggctgtctgacgggcttaaggaagtaaagcccggagaagtggacacgatgattgccgccgggatgggaggcggcctggttatcaagatactaagagagggaaagccggtggtggatacgcttaagtcctgcatcctgcagccccagtcagagatacatagagttcgccgttacgtggcggagaaccagatgaagatcgtggctgaggacatggtggaagaggacggcaagttctaccctataatgaaagtggagcatggaagcagcgcgccttatacggagtgtgaatacctgtatggcaaatgcctgctggaaggaaagcatccggtgcttaagaagtacctggaccgggagatggatatccgggaaagcatctttggccagctgagcaggcgaaagggcagcgaaagcgctgccaggcgtatggaagaggtacgcgaggagatcgtgatgattcgtaaggccctggagtattttgaaagataaggcacaggaagaagggagaatgcatatgctgtgtaaggatgtaatggatgtgatcgaagcggcttatccaagagagtatgcgctggattgggataacgtaggcctgctggcgggaagagatgataaggaagtaaggcggatctatattgctctggacgcgacggatgaagtcattgacgcggcgatcgaaagccaggccgacatgctggtgacccatcaccctatgatattcggcgcattaaaaagaatcaataatctggattttataggaagcaggatactgaaactgatccaaagcgacatctcttattatgcaatgcatacgaactacgacgtgctgggaatggcccggctgtcaggagagaagatgcatctttctaagacagaggttctagaagccacctgcgggaatgggccttcggataacggcgaggaggggatcgggagagtggcagatctggatcgcccggttaccttgcgggaatgcggccaggaggtgaagaattccttccagttgggctccgtcaagatatttggagatcttgatgccagagtgcgcaggatcgccatctcccccggttccggcaagagcatgataaaagcggcgcttgataagaaggcggatgtccttatcacaggggatatcggccatcatgaaggaattgacgcggtggcccaggggctggcagtcattgacgcgggtcactatggcatcgagcatatatttatggaagatatgaagcagtatctgagcagccatctgacggatgtggaggtgatggcggctccgatcgtgcatccatttacaatcatatagcaggaaagaaatcaaggaaaagaggcggttataagatggataagaagatgtacagcgtgcagataggggatgaaatccggcagtacgaggctggaactacataccgccagatcgccgcagagcaccagaaggactatgaggatgatatcgtgctggtatttatcaacgaccggctgcaggaactgcataagacgctggaaggagactgcgtcatgcggtttgagactacgtccgggccaatcgggcataagacctacaaaagaagcatgagcctgatgctggtaaaagcggtctatgatgtggcaaaccacgatgatatcgataaggtacgaatccattattccgtcagcaagggctactactgtacggttgaggggacgattcgtctggatcaggaattcctggagcatgtggaggcgagaatgcgcgagatggtggagatggatatgcccatccataagcggagcatccatacggacgatgccatcgccttattcggacagcacgggatgcatgacaaggagcgattgtttgaataccggagggtatccaaggtcaatatatatagcatgaatgagtttgaggattattattatggctatatggtgcctagcgccggatatcttaagtatttcaaactctatctgtatgatgaagggttcgtggtgcagatgccgacccagaagaacccgagagaggtacctccattcgagcctcagaataagttgttccatgtactcaaggaatccacccagtggggcgatatgcaggggatagagacggttggcgcgctgaatggcaagattaccaacggcgacggattacaggtggtactggttcaggaggcgctgcaggagaagaagatcgcggagatcgcggcgcagattgccgaacgcagagaacgaaagttcatattgattgcaggcccgtcgtcatcgggaaagacgacgttctcccacaggctgtccgttcagcttcgggccaacgggctggttccccacccgatcgcggtggacaattattttgtggaacgggaagtcaatcccagggataagaacggggaatatgactttgaatgcctggaggcagtggatgtagaactatttaaccggcagcttaaggaactgctggcaggaaaagaagtggtgatcccaaggtttaattttgtgacgggacataaggaatatgggagcgacgttaagaaactgggagaaaatgacgtgctggtgatagaaggcatccattgcctgaatcccaaactgacggagagtctgccggatgagaataagttcaagatatacatcagcgccctgacacagttgaacattgacgagcacaaccggattcccaccacggatggccgcctgatacgaaggatcgtcagggatgcccgcacccggggatcttctgccaagcggacgatcagcatgtggccgtctgtcagaagaggagaggagcgcaacatcttcccttatcaggaagaggcggacgttatgttcaattccgcgctgatctatgaactggcggtattgaagccttacgtagaatcgctgctttttgggattgaccgggactgcccggaatatctggaagccaagaggcttctgaagttcctggattattttgtgggaatcggaagcgagaatgtgcctaccaattccctgctgcgggagttcatcggcggtggctgcttcaatgtataaggaatggggatgcgtaaggcatccccatttttatgcgtcgctatatttattttgacttgacttcccgccacagttcattgtagagggcgtcgttttcatctcccaggaattggaaggtctcgcagttcgcaagttcttccggatccgggaaggctatagggctgtttcgaagcgcagggtcttcgatcagctgccttgctgcctcgttcggcgtagagtaggtgatgtagtcaaagttcatcttcgcgatatccgggcggcagatgaagttgatgaatttctcggcgttttccttgtgcttggcgttctttggaatgacccaggaatcaatccacacattggagccttcttttggtattacgtattccaggttgggattctcccactgggtgtagatggcttcgccggagtagatgacgccgatggcggcctcattgccaatcatcttgtcgcgcacctggtcgataacgtaggcctgcacaagaggcttctgcttgatcagcagcttcttggccgcctccagttcatccaggtcggtggaattaagcgagtagcccagatatttcagcgtgactccaaacgcgtcgcgcacgctgtcctgcatcaggatattatccttgtatttctcatcccacagtacggaccagctgtcgataggctcatccaccatggtcttgttatagaggatgcctaccgttccccagcagtatggcacggagtatttgttctccgggtcgaactgcctggactgctccatataagtatcgccgatattcttgatatttgggatgttatcaaaatcaatctctgccagcaggtcattttctatcattctctgtatcatgtagtcggaagggcagactacatcataagcaatggcgccggactggatcttgggatacatgatctcgttggtctcgtattcctcatagacgacctcgatccccgtctctttctcaaacatggagatagcctccgggtccagatattctccccaattgtagacgatcacctggttatcgccgcctgtggctgccttggagccatagaagaagccgcccatgattaccaccactgccatcatgacaggcacgaccttgcggaaaaggaaacggccggccttatggcgccttatgcttctggcggtaacagccttgtgcttatctggcttctcatccggcgctatgttgaccaggatgagcagcaggagcacagacaggaagagtatggtggacagcgcgtacatttccggcttgatgccttttcgaacttcgctgtatatcttggtggacagggtgtccactccaggacccttggtaaaatgcgtgataataaagtcatccagcgacatggtaaaggccagcaggaatccggatgatacgcctggaaggatatccgggaataccaccttgaagaaggcatagaccggagaagcccccaggtccagggcggcctcgtaagtgcttacattggtctgctttagcttgggcatgacgcttaatatcacataagggatattaaaggtaatgtgcgccagcaggatggtggagaatcccagcgagaaccggaaagcgataaagagcagcatcagggagatgccggtcacaatatccgcattcagcatgggaatgttggtaacccccatcatggtggtgcggaacttccggtgcatggactggattccgattgccgccgccgttcctatgaccgttgcgatcagggcggacagaagggcaatgatcagggtcgtatacagggcgttcataatctgctcgttcttgaatagttctacataccactggatggtaaatcctccccatttggagcgtgtcttggatttattgaaagacagcaccatcaaggttacgatgggagcgtacagaagcacgaagatgagcaccaggtaaaaacgctgtaagaatttcttgatcaaaatgcagttccctccccatctttatcgtatttggcaatcaatgccatgctgatgataataaaaatcataagtaccaaggataatccgcttcccacatgccagttgcttccctgcttgaattcctgctcgatgacattgccgatcagcaggatcttgcttccgccaagcaaatcggagatgacgaaagtggtcagcgcgggcacgaataccatggtgattccgctgatgatcccaggcacgcttaagggcaggatgatgcgcagaaatgtctgcacattattggcgcctaagtccctcgcggccgctatgacatccttgtcgatcttggccagcacgttatagatcggaaggaccatgaagggcaggaagttatagaccatgcccaggacaatggcataaggcgtattgatgatctccagggcaggcaggttcaggaaatccaggatcacattgatgactccgttcttctccagaagattctgccatgccagggtgcgcagaaggaaattcatccacatgggcaggatgaatatcagcacgacaaaactggactggttcacgcccaggttggaaaggatcatcgccagaggataggccaggagcagacagatcacggtgctcacaaaggaaagcaggagggcaagccccagcgctttcaggttctccggcgacgtgatctttgcaatattcaataatgtaaaagccccgtccttatcggtcagaccatagtaaaagatcataaggagagggatgatgataaaggatactgaccagaagagataaggtccggccagcagccgcttgaattttcttgtcttattcctcaattgtaaccgcctccgcatcttcagactcaggtttcttcataatctgtatatcgaaaggatctaccttgattcctacctctgttcctaccgggaacatatcggtgctgtgtaccagccattcgtagttgttggccagcacttccatctcataatgcactcccttgaagatcagatgggtgactacgccttccatgatgccttcttctggcttcaccagatcaatatcctccggccttataacggcgtccaccggcttgttacgtccaaagccttcatccacgcaagggaaattgacgcccaggatcttaaccagccggtcttctaccatggtggcaggaagaatgttgctctcgccgataaaatcggcaacgaaagcgttctgaggctcattgtaaatgtcctccggcgttccgatctgctggatgtagccctgattcatgactacgatggtatcggacatggtgagggcttcctcctggtcatgggtaacatacacgaaggtgatgccaagctcattcttcaggcggatcaattcatactgcatatcctggcgcagctttaagtccagagcgcccagcggctcgtcaagaagaagaaccttaggctcattaacgatggcccgtgcgatagcgatacgctgctgctggccgccgcttaaggagtcgggagtcctgtcttcaaatccttccaggtttaccagcttcagggcataacgaatcttgtcattgatgtaggactgggatttgcccttgatcttcaggccaaatgcgatattctgggcaatggtcatattggtaaagagggcatatttctggaatacggtgttgagctgccgcttgttgggggccagttccgtaatattttttccgtcaaagatgacctttccggtgtccggggactcaaagccgcccagaatccgaagaagggtggtctttccacagccgctgggcccaagaagggtcagaaattcattttctcggatatacaggttcaggtcatccaggaccaggttatctccaaaggattttgaaatatttacaatatcgattaatttgtgtgacatggtagtcctcccgtatcatttattcttatctttagaaactgggcggcgtgctgacccagatgatggtggcgccagtactgttcggtgcctctatataatgctcggaatgcggggtgaagtaaaaagattccccttttttggcagtgtagacctttttcccgatatggatcttaacggtaccttttagcacatatccgaattcctccccttcatgggggacatcccggtaggtggaaccgcctggcttgagcgtgaggcggataggctccatcatattcttctgggcgttggggatgatccactcggtcttattcaaaagttccgtatcttctttttcaaaataatcttcatagtggaagacgacctgttcttccgggtcttcgctgaagaattcattgatggtagtccccaggcattgcagaatatcgaccagggtggcgatggaaggagaagtaaggtcccgctccagctgggagatgaaccctttggacagttccgcgcggtccgccagttcttcctgggtaagattcttggcaatccgcagttctcttaattttgggcctatttccataagtacctccttgtttgctgcgtgacagtaaaaataaacataaagtttagtatttcttaactcgtgtgcaaggctcattatactatatatttataaaaaatcaagagattttggggaaaaagttaaagtccgggcgcagaagaagctgcgtgcccggactgggactatttttgatagattttcagaaggttctccatggtgcttgacatgcctgtcatcagaagatccgctatggtgatcgcggccatggattccaccaccaccacggctcttgggacgatgacagggtcatgacggccggtgatagagatggtggcttcctcgccttttcgggtcaccgtctgctgaggccttgagatggagggcgtaggcttgatggcggcccttaggatgatggggctgccatcgcttaagccgcccagggttccgccggaatgattggtcttcttgcagatattgccctggcaggttaagaaagcgtcgttgtttacgcttcccttcgaggcagccgccgcaaagccgtcgccgatctcgacgccctttaccgcgccgatagacatcaatgccctggcaaggcaggcatccagcttctggaagacgggatcgccgataccggcgggcatgccgtcaatgcggcactctacgatgccgccggaagaatcctgctccttgatgcattgttccaggtaagcggacgctctttgtgcataatcgtcgctgggcatgtatagactattatggataatgcaatcatagtcataggcagattccggaaccacgatgctgccgatcgccttggtgtaggctcttagatggatcccaagctgatccagtatcttggaagcgatggctccggcggcaacccgcccgatggtctccctgccggaggtgcgtcctccgccgcggtagtcgcggaagccgtatttggaatcaaaggtatagtcggcatgtcccgggcggtagcagtctttgatctttccgtaatccctggaacgctggtcctgattgcgcaccatgagcgagatgggagcaccggtggtgcgcccttcgaacacgccggagagaatttccacctgatcggattcgctgcgggcagtggtatatttgctctgtccaggcttcctgcggtcaaggaattcctgaatatcgccttcggagagaggaagccctgccggacatccgtcgacgacgacgccgattgccggcccgtgcgattccccccaggtagtcattgtaaataaggttccataagttgatccagccataagtaagtctccttcatatataatagatattcttattatattagaaagggggcaagcctgcaattataaaatattcaggaaatcttcattatttttttgtgatttttcctgtacttttgcatatatgcatattataatgttagcgtgtgaaattttgaaagaggagtaatatctatgggtgatacaggaaaaagagcagacgagattattgaagagaccatgaaagaaatctatgacgaccttaatagttctgatgcttttaaagaaacggatgatgattatgaagattcccaggaagaagaaattaatatggaagatgatgatagcgctgacatatctgatgctgacggtattcttgagacagacggattcgatgagatagacgcagaaggcagtctggaagagtatgacgatatagaggacgaagaattagaatatgatgaattggaagacggcgatatggaggagaccgatatagagaaggcagaaaagaaaaagaagcgcaagaagacggcggcgatcgtggcaggcagcattatcggagtcctggtcctgatctatgtgggatttgccatattcttcagcagccatttcatgttctttacgaagatcaatgggacggacttctctctgaaaagcgtaagccaggtggaggcctatatgaagcagcaggtggcggattatgtcttaacgcttgaagagtctgacggcggaagcgagaagatcagcggctctgatatctctcttaagtatgttccgggcgagcagcttgagaaactggctaaaaagcagaataatttcctttggatcacttccctgtggaatcatccgaagattacagcagagattggcgtggaatatgacaaggatgcccttgcaaagataacggaaggcctggaatgcctgaagccggagaaccagaccgcttccgtggatgcccatccggaattccagaatgacaagttcgtagtggttccagaagtggtaggcacccagattgatacggagaagtttaatgaggccgtgaccaaggccatcaatggattcaagccgactttggacctgtccaaggcaggatgctatatattgccaaggtttgtatctgattcacaggaagtcgtagcggctgcagatgccatgaacagttatctgggagcaaacgttacatatgactttaatccggctacggaagtggtggacgcttccgttatatcccaatgggtaaccgtggatgcagatatgaacgtgacttttaatgaagaagcagtaagagcctttatccagtccctggcggataagtacgataccaagggcaagccaaggacatttacgacggcaaccggcaatacagtaaatgtggaaggcggaagttatggatggaagattgatcaggaggcagagtacaatgcgctgatcgcgaatatccagaatgcggagactgttaccagagagcctaattatgcaagccgcgctgcaagccacgaaggaaatgacgtgggcagcacctacgccgaggtggatctgtcgaaccagatgatgtatttcgttcagaacggccaggtcgtactgcagtcaggaattgtgaccgggaatccgaataaaggaaacggaacgccgcagggagtctattccctggcatataaggcgctggatcaggtgctgagaggaaccaagaagccggatggaacctacgagtatgagacgccggtgaagttctggatgcctttcaatggaggaatcggcttccacgatgctacatggcagacatctttcggcggatccaggtatcagaccaatggctctcacggatgcgtaaacctgccttatgacgtggcatcccagctttataacctgatcacagcgggaacgccggtggtgtgccattactagactacgaagaatatagaaaaatgaggataagatcatgtatgaattattaaagaaggatggtcttgccaaaagaggaagattgcatacagtacatggggtcattgagacccctgtatttatgaatgtgggaacagtggctgccataaagggagccgtatcgaccacggatttacaggaaatcaagacacaggtggaactttccaacacttatcatctgcatgtccgaccaggggatgaagtgataaagaaactgggaggccttcacaagttcatggtctgggacaagccgatcctgacggattccggcgggttccaggttttttctctggcaggacttcgcagaatcaaggaagagggggtatattttaactcccacattgacggcaggaagatattcatgggcccggaagagagcatgcagattcagtcgaatctggcctctaccatcgccatggccttcgatgaatgtccgtcaagcgtagccgagaagggctatatcgagaagtcggtggaccggacgactcggtggctgatacgctgcaagaaagagatggagcgtctgaacagcctgccggatacgatcaatcaggagcagatgctctttggaatcaatcagggaggcatctatgaagatatccgtatccgccatgccaaggagattgcagatcttcatctggacgggtatgccattggagggcttgctgtcggcgagtcccatgaggatatgtaccggattctggacgctgtcgtgccgcaccttccgcagaatgcgcccacttatctgatgggcgtgggaacgccagccaatattctggaggccgtggatcggggcgtagacttctttgactgcgtgtatcccagcagaaacggcaggcatggccacgtgtataccagccacgggaagttaaacctttacaatgccagatacgagctggatgagcgcccgatcgaggaagggtgcggctgtcctgcctgccgcacatattcaagagcctatatccgccatctgctgaaggcaaaagagatgctgggaatgaggctgtgcgtgctgcataacctgtatttctacaattctatgatggaagagatccgccaggcaattgaagaaggacggtatcaggagtataaaaaagagaagctggaagggcttatatccggcagggaataaatgtaaaatttacatgaattatacaaaatgacttgatgaatgtagcattattgtgtatgatagcaatagtgtttaatgagatttaggaggaattagtatgtacacattagcagcacagagttcaggaggaagttgggcattactgattgtagtatatgcagtaatctttggcggtttctggtttatctttataaggccacagaagaaagaacagaagagagttcagtccatgatttctgagatggaagtaggggataccgttcttacgaccagcggtttttatggagttataatcgatatcagcgatgacgatgttatcgtagaattcggaagcaaccggaattgccgtattccgatgcagaaagcagcgatcgctcaggtagagaaggcttctgccgagtaagaatcgcatgatagaagagaatcctgacagggagacgtttttaagacgtctccttttttattgaaaccttacatcgtctgtaagtatgattcggtacggccatttgctataataaagacaaagaaaggcaagggggagaaacgatggattggaacaagatacttcaggtcaagaatgtcaccaagaattacgggaagggcgagagcaggacggcagcgcttcggggcatcagctttgatgtgctggagggagagtttcttgggatcatgggagacagcggttccgggaagaccacgcttctgaactgcatagccaccatgaccaggcccacgtcaggagaaatactgctaaacggcgaggctatctctgccttcaagggagccaggctttcaaaatacaggggaggaaagatcggctatctgtatcaggaatttgaacttttggataacctgacggcgagagagaatatcgtgctgccgctggcgcttcatggaatcacgcaaaagcaggcacagaggagtcttatggaactggcgggccggctggacattgttccggtgctggaccggttcccttctcagatgtccggggggcagaagcagcgcgtggcggctgcaagagcgctgatcacgcagccggagatcctgctggcggatgagcccaccggagccctggacagccgcaattcgaagattctgctggataagatggcgatcatcaaccaggagcagaagaagacgatcatgatggtgacccatgatgccaatgcggcaagctactgtaccaggattctgttcatacaggatggccgcctgttccacgagctcagaaggaatccccgcaaagaggatcgcgaatctttctatgagaggatcgtggcagtcatggcacagctgggaggaggaagcgcaaatgttctttaggcagattcggcgaagcgccgcaaagaaccggaagaataacagcctgttttttggaaccctggtggctgcgatcgtagccttctatactttgctctcgcttgagagccaggatgtcattcgtttcctcaagacgttggaaagcgatgcgatagagaggctgatgctgctgattcctgtcgtatatgcagtatctttgttcttcgtattcttcctggtctacttcgcgtaccgctatcagatggatgggcgcaggaaagaatttggcctttacctgatgctggggatgggccgcggcaggctgtttgccatgcttatgggagagacgctgtggaacagcctggtctctatcctgaccggtcttccgatagccttgcttcttacagaaggaatcagcctggcgacagccaaggtgatcgggcttggaatcgtcgggcataagatatccctgtccttccctgccgtgctgtggaccgtggcaggattcatccttgtgcagtgcattgcaatgctggccttgtgcgtccagtacagtcgaaaagagccaatggagctgatgcaggcagtcgggccagaacggcaggcagcggcgggcgaaaagaggaggaaagccagcctgattcttgggctccttcttcttttgatggcttacggggcagggatcatgcttcttcgtggccttggcctgccagtgatcgcgctgatctttctgcttggaggaagcggaactttcctggtgtttcaaggcattggctccttgattggagagcgcatacaaagaaaggggcccagccagcccggtctttatacctttactggcagacagatccaggaaagcgtggtagatcagtataaggcattggctgtagcctcgctgttgcttctgctggcgcttgcgtgcatctcctttggcattggcatggcggcaggaagaggctcgggcgagacaaggacggcggacttctcggtcaaggggacagaggctgagattcaggaaggcatccgaaggcttgacgatccgtccatgatagcggggtattatccgatgtatctcggacatatggatatagatgcgcatgcatattccttaaaaggcttgcaggaagcgatcctgaagcagccggatagtacgcagaaaagcagccttcaggatcatctggggtatggactggaatatgtcatatccgaggccagctataaccagctgcgcgcctccataggaaaagatcccatagaactgggaccggatgggatcgggctgtatacatccatgaaggatgaccgggcatttacagaccttctggaacacacgttaaagagcaggcccgaagtgagcgtcgacgggcaggattacaggctggttccagaactttacagcgataatgtggtagcggacagggaaattacgctctatatagcctttatcgtgccggatgagaagtatctggcctggaccaaagacgggcaggagcccttctgctggaatatgacggtgagccaggaggccgtagatgagctggggcttatgcaggcaattcagaaggtggatgaaagactttcctctaccggactggaatatgaaagctatctcagcgggattggcaggaatctgttctatacagtggcatccagctatctgtccatctatctcggcgtactgttcctgctgatctccaatacggtcatcggccttaagtatctgatgcagcagcatgcctgcaggcagcggtaccggacgctgctcatgctgggggcagggacgaaagaactgtgcaggtgcgcggggcgccagattggcatctttttcctgctggccatcggcgtggcggccatcaactccatttttgcagtgtggtccatgtttggcagttttatgaggctgccggcggggacggctgcttccaaagtttttttgatggcaggggttgcatttctactgtttcttgtgtttgaatggatctatatccatgttgtcataagcgccagccaccgggagatacggacgcttcgggcaacggacgggaggaatgccttgtgagcaggattatagtagtggaagatgacagatatctaagagaagaattggtaacgacatttgaaaggaagggatactcggcgtggggtatctcttcctttgatgaggcagaaagggaaatccttgcgtacgctccggatctggcggtgctggacctcaacctgcctggaaggtccggattcgagctttgcaggcggctgaaggcaagggcggcatttcccattctgatcctgacggcccgggacgccctggcagatgaactgcatgcgttgggacttggggcagacgactttcttacgaagccgtgccatcctgaccggctaactgcccgtgtggcccgcctgataaagacctatggaagagtgcacgattccttgcaggcggggagcctcatcctggatctggacgcaggcagggcggcctttaaggacaggcatacggatctgacggagacagaaggaaagattcttaagatgctgatggaatattatccacagacggttccaaaagaagaattattcgaaaggctgtggggcggcagcgaatatgtggatgacaatatcctgcaagtgaatatggcaaggcttcgaaagagcatggatcacatcggcttgcgggaggcgatccgcacggtgcgcgcccggggctatcggctggaggtggaaagatatgagggagaatagatggaagatcaggcaggagctgccgtggatcattctggtggctgcaagcgaaggcttctttaccttcgtactatggctggccgcgccggatgccttcggaagcatcgctgtgatggctgccatctttgccgtgctggtcatcgcgtccgggtgcatcatagggaagaggcggcaggaaaggcagatggatgcgctgcaggcatgccgcgaagaactggaagaagcggcaaggaactgtcagaagcaggaaatgcaggactatcaggagtatatcgaggcatggacgcatgaagtcaagacgccgttatccctggctacgctggtgcttaataaccacagggaagagatgtctccctatgtctatgaccggatggctcatgtccatcacgccatcagcggcaatgtggacagaatcctgtactatgcaaggcttcaggcggatcatgtggattataagttcgagaggctggatctggagacttgcgtcagagagagtctggatgatttccttcccatcgcaaaggaacggggaattgacgtaaagactgatattgcgtccatagaagtgataagcgaccggaaggtgcttgccttcatgcttgcacagatattcagcaatgctctcaagtatgcagaccaggaatccggccgggtaagcgtggctggctggatggatgccaaggaggaaggcaaggcacatctgaaagtcagggacaacggaaatggcgtgccttatgaggatcttccctttatcttcgataagggattcaccgggcataggacagacttccggaattctacaggcatgggactttactttgtaaagaagtatgcggaaaaactggcaatccaggtgaagatcgacgaggcatctacgtctggcaggggatttgggattgaattgattttataaagtaatattttccttgaaaacaggaatacttacaatatgtattccaaatatttcaaggaagggagaactgttatgaaattaaagagaatcctggcggcaggactgatattatctatgaccgccggcatggctatgaccggatgcggaaagaaggaggaaggaaaagcctccgtctattacctgaactttaagccggaggtggcaaagcagtgggaagagatcgcgaaagagtataagaaagaaaccggggtagaggtaaaggtggtgacagctgcctccggcacttatgaatcaacgcttaagtccgaggttgccaagaagaatccgccgaccctgtttcaggtaaacggacccatcggctatcacaactggaaagattactgcctggatctggcagatacggaagtttataataatctgacagacaaggacatggcaatccggggcgtggatggcaagggcgtctatggaattccatacgtggtagagggatatggcattatttataacgatgcgatcatgaagaagtattttgcactgccgcaaaaggcggtagagatcggttcagcagaagagattaaagattttgaaacattgaaagctgtagtggaagatatgaccaggcataaggacgaactgggcattgaaggcgtattctcctccacttcttttgcggcaggggaggattggagatggcagacccatcttgccaacgttccgatctactacgaatatcaggaaagcggcgtgacagacaaagagaagattgactttacctacaacaagaactttcagaatatcttcgatctgtacctgaataattcttgtacggaacctggacttgtaggctccaagacggtggaagactccatggcggaattcgcccttggcaaatcagccatggtccagaacggcaactggggatggggacaagtctctgacgttaaaggcaatgtcgtaaaggaagaggatgtaaaattccttccaatctatacaggaatggatgaggatgcaaaacagggcctgtgcatcggcacagagaacttctggtgcgtcaacagcaaggtggatgaagccaagaggcaggctgccattgaattcctgaattggctgaccaatgaggagaagggcaagaaggaaatggtcaagcttggattcatctccccatttaagacgtttggcgaggatgagcagccggatgatccgctggcaaaagaagtggtcagatatatgaatgacaatggacttgaaaccatatcctggaattttacctcatttccaagccagaccttcaaggataatttcggcgcgtccctgctggaatacgcccagggaagcaaggaatggaaagcggtggtatctgatatgaaaaaggactgggctgcggaaaaagccaattcatcggacggtgaatagggaaggagcaagttatgcagaagaccttaaagagatattttcctattttcgtgcttccgaccctgctggcatttgcggtcgcgttcctgattccgttcataatgggaatctatctgtcgttctgtaactttacaaccgtgatcgatgcaagattcacaggcatcagcaattatgccaggatgttctcaaaccaggacttcctgtcagcgttgtcctttacggcaagatttacagttgtttcagtcatcctgatcaatgcaggcgcttttcttctggcgcttgcgcttacaaaaggaatcaaaggaaccaatctttaccgaaccgtattctttatgcccaatctgatcggcggcatcgtgctgggatatatctggcagctgatcatcaacgcggtgcttctgcgatccggggttaccataaccaccagcgcaaagtacggcttctgggggctggtgatcctcatgggctggcagatgatcggatatatgatgatcatctatatcgccggcatccagaacatttccacagaactgatggaagcggcaaagatagacggggctacgaatcttcagatattgggaaagattacgatcccgctggtcatgccctccatcaccatctgcctgttcctgacgcttaccaactccttcaagctgtttgaccagaatcttgcgctgacggccggactgccggggaggcagacgcagatgctggcgcttgacatctacaataccttttatggcagaaccggctgggaaggcgtagggcaggccaaggcagtggtattcttcgtgatggtggcggcgatcgcgctgctgcagctttattttaccagacgcagggaggtggagaactgatgggaaggccaaaagcaaagaaagaggaggacgtaagcgaactgtcccggagagcaggcgtgacgctgaccgtgggaatcggaattctggcggtgattttcctgctgcccattctggtggtgctgcagaattcatttaaaagcaagctgtatatcagtaatgacccctttgccctgccgattggcgatctgtttgcagggcttgagaattacgcgggagggatagaaaagaccggatttttgtccgcattcgggtattccttattcatcacggtgttttcggtagccctcatcatcctgtgtacttcgatgaccgcctggtatatcgtgagggttaagaatcgctttaccacggcgctctattatctcttcgtcttcgcgatgatcgtgcccttccagatggtgatgtttacgatgacgaagatcgccaacatgctgtatctggataatccggtgggaatcatattcctgtacctggggtttggctgcggcctttcggtattcatgttctgcggatttatcaagtccatcccgctggagatagaagaggcggcgatgattgacggctgcgcgcctcttcagacatttttcaggatcgtgcttccgatattgaagccgacggtgatcaccatcgccatcctaaatgccatgtggatctggaacgattacctgcttccttatctggtcattggcagcgactataagacgatccccatcgcggtccaatatctgaggggcgggtatggctccgttgatatgggcgccatgatggcgatgctggtactggccattcttccgatcatcatcttctatctgctcagccagaagcatatcattaagggtgttgccgcgggagcggtaaagggatagtggaaaaaaacctggatttgtggtagagtgtagaggaaatggcaaaaggaggaagattatgttagaaaatgaattgacagccttggtgcagacaaaattaaataaagagatgaaagatgcaagcgataaggaactatattatgtcctgcttgcctatacgaaagaaagactgaaagagacgccggtgattgagggcgataagaaattatactatatttccgcggaattcctgattgggaagcttctgtctaataacctgattaatcttggcatttatgaagaggtggcggaagtcctgaagaaaaatggcagggaactatcccggattgaggaagtggagccggaaccatcccttggaaacggaggacttggaagacttgctgcctgtttcctggattccatcgctactttgggccttgccggcgacggaatcggcctgaactaccatatgggcctgttccgccaggtgtttcagggccataagcagaaggaagtgccgaatccctggatagaggccgagagctggcttacggatacgggaattagattcgaagtgccattccgtgattttaccctgacatccagactgtatgacattgatgttgccggctatgagaatgggaagaacaagctgcacctttttgatgtggaaggcgtggatgaaagcattattggggatgggatcaactttgacaagcataatatcggcaagaacctgacgctctttctgtacccggatgacagcgacaaggcaggcaaccttcttcggatctaccagcagtactttatggtatccaatgcagcccagctgatcttaaaggaatgcaaggataagggatatgaccttcgccggctgcatgagcatgtggcaatccagatcaatgatacccacccgtccatggtgatcccggaactgatccgcctgctggtgcagaatcagatcgactttaatgaagccatcgagatcgtgcagaagacctgtgcgtatacgaaccatacgatcctggcagaagcgctggagaaatggccgctggattacctggagcaggtagcgccgcagatcgtgccgattatcaaggatctggatatgcgcgtcaagggaagataccaggatccaagggttgccattatagatgagcagaaccgcgtccacatggcacatatggacatccactttgggcacagcgtcaacggagttgcggctcttcatacagagatactgaagaattccgaattgaagcatttctatgatatctatccgcagaagtttaacaacaagacgaacggcattaccttccgaaggtggcttctgcactgcaataaggaactggtgcgctggatcagcgggtatgtggaggaagacttccgaaaggatgccaacaagctggagaaactgttgcgctacattgacagcgagatcgcattagagaagctcctggatgtgaagcaccagaagaaagtgcagctggcagaatatttaaaagagacgcagaggctggaactgaacccggattctatcttcgacatccagatcaagcgcctgcatgagtataagcggcagcagatgaatgccctgtatgcgatctataaatatatggaaataaaggccggaaagaagccgcagataccgattaccatgatcttcggggcaaaggccgcgccggcatataccatcgcaaaggatattatccatctgatcctgtgcctgcaggaactggtagatcatgatccggatgtggcgccatacctcaaggtagtcatggtggaaaattataatgtaaccatggcagagcatctgatacctgcctgcgatatctcggagcagatatccctggcctccaaggaagcatccggaacgggcaatatgaagttcatgctgaacggggcggtaacgcttgggacagaagatggggccaacgtggagatccacgaactggtgggcgatgacaacatctatatcttcggcgagtccagccagcaggtcattgaccattatgcgaaccgggactaccgggcagtggattactatattcatgacgagcagatccgctccctgatcaacttcattatcagcccggagatgatgaagatcggcgatccttaccatctgcttcagattcatgcggaactgatccagaaggactggttcatgacgcttctggacctgaaggactatattgccaccaagaaccgcgcatacgaagattatgcggaccgcaaggcatggagcaagaagatgctgaccaacatcgcgatggcagggtacttctcctccgaccggacgatagcagaatacaataaggatatctggcatctgaaataatttgaaatagcaggaatgtgggcagcgtgattcggcttgaatcacgctgcccctgtgcttttataatggtttaatcaagtttttcataggataccaattggctcaatgggatacgcgctgacagatggcgttctggatctgccggcgcttcattggcatagccgatagccaggatattgatcggttcaagagaatccggcagctgaaattcttcttttataatgtcgggcttgaagaaacatatccatacagaacccaggccaagttccgtagcttccagcatcatatggtctgtcaaaatagaagcatcgatatccgtagtttttttgccgtcaaaaggacgtttccatgccttggaatggtcggcgcagacaaggatcgctaaaggcgccccatgtagattagcagccttggaaatctttgttaacccttcttcttgttgtatgaccagcaagcgcacgggctgcagattggcggcggtaggcgcgacatgtgctgcatttaaaatttgatcaagtttttctgcctctactttcttatctgtatatttcctgacagaatagcgtgtttttgcaatatccataaaattcataaaaaatcctccttgatttgtcgttgtgtatcaggttaacctatactataattatacctgcaatagagtatacgacaagaacgcactattaagttatatactacctaaaaagaaagtatggtgatttgatgaataggaaatgcggtgaatttacttgtcctgtcgaagccacgatccaattgatcggcggcaagtataaatcggtcattctgtggcatctaatggggaagacattgcgttatagcgagatccataagttaatgcctaaggcgacggataagatgctggcccagcagcttcgtgaattagaaaaggatggactgataaatcgaaaggtatatcctgtcgtcccgccaaaaacagagtattcgcttacggattttggcaataccctgtcgccgatactggtcgaaatgtgtaattggggcaaacagtatttggactatcaataaatgctataagtctaaagcatattgcacaaaatcgcatacatgattagtaatgagaataattatcagaataagacttgatatttttatttccgggtgatatactgtgcgggaaaatgaaaacctgatacacgaaaggggataaatagaatggcacagtatgaacagtgggaagggtttaagggaaggctatggaaagatgacgttgatgtaagagacttcatccagaacaactatgttccgtatgaaggcgacgcgtcatttttggcggacgcgactgaagcaaccgacagactctggggcagattgcaggaacttcagaaagaagagcgtgcaaaaggcggagtactggatatggaaacagagatcgtatccgggcttacggcttatggccctggatatattgaggaagatatgaaggatctggagcaagtggtgggccttcagacggacaagccgctgaagcgcgcttttatgccctacggcggtatccatatggcggagcaggcctgcaccacctatggctatcagccaagcgagaggcttcacgagatctttaccaaataccataagacgcacaatcagggcgtattcgatatctatacgccggagatgaaaagggcgcgccacaataagattattacgggcctgccggatacgtatggcaggggacgcatcgtaggggattaccggcgcgtggcgctctatggcatcgactacttgatcgagcgcaagcagcaggattttatccgcggcgagaggcacggcatgaagggcacggatttccgcctgcgggaagagatcgcggaccagatcaaggcattaaaggaaatgaaagagatggcgtcggtctatggctatgatatctcgcagccagccaaggacgcaaaagaagcagtgcagtggctctacttcggctatcttgcggccatcaagacccagaacggggcggctatgagcgtgggacgcatttccacattcctggatatctatatgcagagagacctggaaaagggaacgcttaccgagacgcaggcccaggaattgatcgaccacatggttatgaagtttcggatggtgaagtttgcaagaatcccgtcatataatgaactcttctccggagatccggtctgggcgaccctggaggtgggaggactgggacaggatggacgctctatggtgacgaagaacgattaccgattccttcatactctggaaaacatgggcccatcgccagagccgaacctgacggtgctctattccccgcgcctgccggagaactttaagaagtatgcggccatgatatccgtgaccacaagttccatccagtatgaaaatgatgatgtcatgcgcccggtatggggggacgactattccatctgctgctgcgtgtcagctacccagacaggcaaggagatgcagttcttcggcgcccgcgccaatctggcgaaatgcctgctgtatgccatcaatggcggcatcgatgtaaaatcgagagagcaggtagcgccagcgtacaggccggtcacctcagagtatctggattacgatgaggttatggaacgatatgacgctatgatggaatggctgtcaaaactgtatgtggatactctgaatatgattcactacatgcatgacaaatacaactatgaggcagcggagatggcacttatcgacacggatgttagacggacattcgccaccgggattgccggattctcacatgtggtcgattccttgagcgcgatcaagtatgccaaggtcaaggtgattcgggacgcggatggcctggcggtggactttgagacgcagggcgacttcccaagatacggaaacgatgacgaccgtgcggatgagatcgcgatctggcttcttaagacgttcatgcataagcttaagaaatgccatacctaccggaattccgaacccacaacttcaatccttaccattacgtccaacgtggtgtacggcaaggctaccggatcgctgccggatggaagaaaagccggagcgccattagcacctggggcaaacccatcatacggcgcggagaagaacgggctgctggcgtccctgaactctgtggcgaagcttccttacgaacttgccctggacgggatatccaatacgcagactatcagcccgggcgcgcttgggcacagcgatgaggagcgcacggacaatctggtaggcgtgctggacggatacttcagccagggagcgcatcatctgaacgttaacgtatttggcaccgagaagctgattgatgctatggagcatccagaaaagccggaatacgccaatttcacgatccgcgtgtccggatacgcggttaagttcattgatctgaccagggaacagcagatggacgttatcgccagaacctgtcacgatagaatgtaagaaggagcaagagtatgacaaaaggatacattcattctctggaaagttttggctctgtagatggaccaggcatccgctacgtgatatttacctccggctgcgccatgcgctgccagttctgccacaacccggatacctggaatatgaaggcaggaaccccatatactgcggatgaactgatagacaaggcgctaaagtaccgcgcttactggggaagcaaaggcgggatcacagtcagcggaggcgagcccctcctgcagatcgactttttattggaactatttaaaagagccaggcagaaaggcattcacacgacccttgataccagcggaaatccatttacgaaaaaagagccgttctttggaaaattccaaaaactgatggagtacaccgatctggtgctgctggatatcaagcacatcgatgacggacagcataagatcctgaccggacaatctaaccagaacatcctggaactggcagaatatctctcggatataggaaagccggtctggatccgccacgtcctggtgccaggaagaagtgatgaagatgcatatctcataagacttcgtgactttatcgcgaccctgaagaatgtagaaaaagtagaagttcttccctaccatacgctgggcgtatataaatggaaagaactggggcttgagtatcctctggaaggggtcgagccccccacaacagaacgcgtggagaacgccaagcgtatattgaacacgtaacaaaatgaagatgtgcacgtaacacttttcaaaagtgttacgtgcacatcttcattttgttacgtgtcaacttgcctcaactggtgcgtaaaatcgtcacaactggtgtgccaaattgaatcggtcagccagaaggagccagttggcccgaaagagctgcatgatctgccagtaggatacgcccctaaggccgaactcttcgacaaggtcgaattttccattcaggctgcggacatcttcgaaccacacttcgtgctccgtgccgttggaccagtagcggaagaaaggagactgggcgatatcgtcaaattggatggcagcgccttgggagatggccagctgcacggcctccacattgccgatggtacgggcgcgggaggtgcctcggacgaagggcagcgcccagtcatatccatagttgggaatccccagatggatcttggaaggggggatcacggtgaccgcatattccaccacctcccggaccttgttaagcggggcgaccgccatgggaggcccataggtgtagccccactcgtaagtcattaaaaggacataatccgcagtctcgcccagccgccggtagtctttgccctcatagagaagtccggtctgggtatccgaggtcttcggcgccagggcgacgctggtcggatacccgagggcgcttacggcttcttgcatataggcgacgaaatctacaaaggcatccctgtcttcagcgaggatgtattcgaagtcgatgtccagcccctggaatccccgggccgtgatctgctccacaatcgcatctttaagacgtcttctggcatccaggttatttacaacctgggaaatcaaggaattattaaaacgcccgtccggcccaaaaggcgtcaaggtaagaattggcgctgtgccaaaggctctggcggcctcgatcatccaggcgtcatccagcaaaggctcgatcagttctccttccattgtaaatccataggaaaatatatagagataggagagataagggagcgtctcccgaagaacccacgggctgataaagggataggcatatccgcctgcatagattgtagagcggggagaagagatacccgcgggcgttggaagcagcagggcttcgcctatggcaagctggtatggatagggaagctggttctgatagacgattgtagaaacaggaatgccataggcagcagcgatgctgtccacggtatctcctggcttaacggtatagatgagcatggcaattctcccgaaaagtcgattcagataaacgtatgaaggtgattgcgaatatataactataaattcgaaccccaattctctttttcgcatatagtagaataaggctaaaggctcgcattatcgcagagtcttttacagatataggaagtgacggcatgaagcattgcaggcatatggcggatttaagcccgggggaaagggctattgtaatagacatctgcatgaatacggatatgcgcagacgtctgcaggacatggggctgatagaaggtactttggtagaatgcgtgggcatcagccctctcggagatccatgcgcatatttgattcgcaggacggtaatcgcgcttcgcaaggaggatgccagccaggtgaggatcaggctggtcgcatgagggaagggcacggcatactgtgaatatttatttgttccgcacaggacagacgtaactttcatatactattataaggctatggcccaagcaggactgctggggcctttgtgaaataaggcggtgatcatatgattcattaccggcatatggaagagaggcggtggtgtcagaatgggtaaggttcttgcactggcggggaatcctaatgtgggaaagagcacggtgtttaacgcgctgaccgggctgaagcagcatacgggaaactggccggggaagacggtaagcaatgcccgaggcacatgcgactataatgggaggcagtatgaactggtggatcttccgggatgctattcgcttatggcacattccgaggaagaggagattgcgcgggattacatatgttttgcacatccggatgcagtcattgccgtctgtgatgccacctgcctggagcgcaacctgaatctggtgcttcagattatcgaagcggctgagcaggtgatcgtatgcgtaaatctgatggatgaggcggcaaaaaagcagattcatatagatatcaagggactttcaaaagagttgggcgtgcctgtgatcggaatcaccgcaagagaagaaatcggcctggaacgcatttttttaacgctgcagcagatggaaaagcagaaggatcataagccccaggcctttgtgtatgaaggacccatggaaagggcgatcggcatgctggagccggcggtggagtgggcgacaaaaggagaagagaacaccagatggttctgtgcccgcctgctggatgcgaacagtaatctcctttattccatggaggaatatctgggatattccctggtggaggatacggaggttgcaggcgcgctgaaggaggcggttgaatacctggcccaagccggatattcaaaggagaagatcagcgacgccatcgccgcgtcctatatccgcagggcagagcagatcaacaggaagacggtacagtacgggaagaaggattatgaccgcagagaccggaggctggactggatctttaccagcaagaggaccggattcccgatcatgttcctcatgcttcttctggtgttctggattaccatctgcggagcgaactacccgtcccagctgctctcggatgggctgttctgggtggaggataagctggtattggcggtgcaggcggccggcgtcccgaagatgatatatgagccgctgatctatggagtataccgggttgccgcctgggtgatttccgtcatgctgcctccaatggccatattctttccgttgtttacgctgctggaggatctgggctaccttccaagggtggcgttcaatctggatcattgcttccagagatgccatgcctgcggcaagcaggcgctgactatgtgcatgggatttggctgtaacgcagtgggagtgacgggatgccgtattatagattctcccagggaacggctgatcgccattatcaccaataactttgtcccttgcaatggcagatttcccatgctcttgtccattatatccatgtttctgattggaaatgcggcgggcatattttcctcttttttatcggctttgctgctggcaggcgtcattgtgctgggaattctgatgacgctgctagtatcccgaatcctgtcgggaaccatcctaaaagggcttccttcgtcattcaccctggaattgccgccataccgcaggccgcagattggcaaggtgatcgtgcgttccgtgcttgacaggaccgtcttcgtgctgggaagggcgatcgcggtggcagccccggcagggcttgtcatctggctgatggcgaactttaaggtgggagacgccacggtgctggcccgctgcgccgacttcctggatccatttgcccggctgatggggctggacggcatcatactgctggcctttatcctggggatgccagccaatgagattgtaatgcccattgtggtcatgtgctatctggctcagggcagcctgctggaactgggagacagccaggccatgtggacgctgctatcccagaatggatggacctgggtcacggcaatcagcaccatgctgttttcactgatgcactggccctgtgctaccacctgccttaccatacgcaaagagacgggaagccttaagtggatgctcctttccattctggtcccaacggtggccggcattgccgcgtgtatggcatttacgttcatagccgggcttgtcatggcatagttttgttatgataagaatagtgcaggttacgggggagataggaagatgcatataaacgagaagcagggggccatgctggaagttttccttttatgccttatgctggcaggaggaggcattctaagctggaataggggggatgccgatacggagagccaggtaaggtctgtccgtcaggagagttctgaagaaaaagtaaaggatccgggcacttctggaaaggagcgggcacaggaagaagagaaggattacataaaatgggtggaattcaacgtaacttgcgaggcaatgaagaaggcgtaccagtatgatctggatagttatggaaaggatccgcatcttcattgggtggatcttctggcaattctaggcaccaagtacggtggagacttcaccaggtaccaggaggaagatctggcggatatcgccgaaaaactgctggatggaagccagacggttgaggaaatgacgaaggatatggagtattatccctactaccgggaagcatacggcgcggtccttgacgggatggtgggggaattccagtacgtacatccgaagaagaaggtttatggactgaaggcctacagcccgattgcgaaggaatttccctattcggattatgatgactttggcgtgtccagaagttatggatataagagaaatcatctggggcatgatatgatggggcaggtaggaacgcctgtgatcgccgtggaatccggctatgtatcagcgtttggatggaaccagtatggtggctggcgcatcggtataaacagttttgacggcaggcgctattattactacgcccacttaaggcagaaccgcccttatgcagaaggtttaaaagaaggagcggtggtgcaggcaggggatgtcatcggatatattggcagaaccggctacagcacggaagagaatacgaataacatcgatgagtatcatctgcattttggcctgcagttgatttttgacgaatcccaaagggaaggaaataacgagatatgggtcagctgctacgaattgaccagatttctttcccagaaccgctcggaagtacagcgcgatgatgaaacgaaggaatggacccgcgtccgccagataaaggacccggaggcaatccgctatcggaacgagcaaaaagaaaaatcagggacagagcagtaaactctatccctgaaacatattttccacgtaactgttcatttcttcccggcttttgacctggcgggctccatccacgattctttcctgctcctgtttcgaaagagaggcaaaacggctgagaatgtcggaatgctgggccagagacatggtaaagccaatgggaagttcttcattgtctatcatttgctatcacctcatagttaggatgtgcaataacaggaaatttatgagactgaattgaaatcagaaattttattaaaatcatataaatagattgactaaataaactgaaaaggctaatataaagataacaagaggatatttacctacacagatgagaaaggggttgttggtatgcctgaaacaattcgaatatttgtaattgtcacatgcgtaatcttaatcggagcgctgcttatcttgtatataggcggccgggcggatgctaagaataatctgcttcacagggcttggaactcctttttatgtgcatacctgaaattggatatccatatgagttatggagccgattatctaaagaatggacgcaggaccacatatgaggaggaattcgcaggctaccgtccgcagggagaagcaggagaggggatccgcagaaagaagatgcgtctggaagaattgcagaagacgggaggcaatcggcaggagttaggaaagaaggatcggtataatcttaagatattaaaataaagctctataaacatttgaagatggggacgtcccccatgatctagaggatcgtggccgggacgtccccgtttctttgcgaggcttgcatttcgcgggagaatggtataatatcaattgcgactagaaagaagttggtggatgattatgagattaaagaagaagatgccttaccgggagcgcatacgaaggttctacaggcgtttccggtggcagccgtggcttctggcggcgctggccgcagcggctatatttgcgttccataacgaagggctctatgatacgcccgtgggaaagatcgtgaaggttgacacgcagcagtcgggaacggctaccaattataattccctgtctgagaatgactcggaacctgtctaccgccagaagatgacggtgaagatactcaatggcaggcataaaggaaagcgagttacggtggcgggagaatacgactatacaggcatggataaggaagcatacaggaggggagacaaggtgttcctaagtctctcgggagaagacaagatatcttctgccagcatcaaaggggtgaaaagagaccagtacgccgttctactggcagtcatcttggcctatcttgtcatcatccttggcaaaggaagggggattctctccttgtgctccattggcatgaatattgtcatctttctctatgggctggcccgctatgaggcgggggatgaccttatggggatctgcgtggccatgatcgtggcattcacggtgctgaccttgttcctggtaaatggagtgaaccgccggtcgctggtggcgattctatccgcgcttgcgacggccgccctgacgatggaaatttttcttctggctatggaatatggaggagagatagactatgcggctcttgactatgtggcgggaggacaagatctggaatccatctttatcgcaagcgtggctattgccggactcggagcagtaatggatgtggcggtgtccattgcggctgctttgaatgaactgatcttaaaggatcccgggatctctgtaaagagtctggcccgctcaggaagagagatcgggcatgacatcatggggaccatgatcaatgtactgctttttacctatatctgcgggctgattccgcttatgatcatgaagatgaagaatgaggtaagcctgctgacgatcgttcgcctgcagataccttttgaaatcagcagatttctgatcggaggcatcggaatcgtgctggcaatcccagtcagcatcgcattgtcctccataatactgaagatagggaggaaaaagacatgatctatattctggcggctgtattcttcctccttctgttgattgtagggggagacagaggcgcggtatctctgataaccctggttggaaatatgctggtatttctggcggccgtggtggcgatggcagcccggatccatccaatcctcgtgacggtggcaggaagcgtggcagtcaactgcatcaccatcctctatcagaacggaaccgggaagaagtccatctccgcacttttatccgtaggggcggtcatgctggcacttctggtattcgttttctggattggggggaagatgcacattggcggattgaatgagattgatatgaagagtgatctgagtctgtactattcctttaatatccatgtggatatgcggatggtatgcatatccatgattatcatcgggctactgggagcggtgatggattcggcggttgccatttcctcctccatctatgaggtgtatgacaacaaccctgatctggggacgaaagaactgtttgagtctggaattgccatgggcaaggatgtgatggcgaccacgctgaatacgctgtattttgcctatataggggaggcgctgatgctgatattgtacttgaggcagtaccattattccttggtgtccatgctgaatgccaaggcattcctccaggactttgcctgcatcgtgatcagcgccataggctgtattcttgtgattccggtatgtgccgggatcaccgccaagatcctgaaggagcagtaaggtcagatgtcgatggacttgatctgcggatactcctttagtaattgaaatatatcatagatatcgtaggcttcagggaagcgtacatacagccggatctccaatgttgctgcgtccacacgcttggcagtaatattggagatttttatcttcttagtggcaaagatgtcagttaataggaccttgatgtcctcggatccgtctaccaggatggtgatctgctcgatggatgaacttctggggtggaggaatcgggtatggaacagaagttgaaacaggaggatgagcagggtggaagcggcgcttaagatatacatgcctgcgccgaacgccatgccgatgcctaccgttgcccagattccggcagcagtggtgatgcccattacattcatgtggcgggtgaagatgacgccggcccccagaaagccgacggcagtaaccactccggcagcaatacgggaggggtcaagcccgatatgctccataaagagtatgtcgtagaatccatatttggatatgagcatcattaaggaggaggccagagccacgatagcatgagtacggatgccggccatcttcatatggctttcccgctcatagccgatcatcgcgccgcaaagggctgcccccaaaatacgcagaaaatagatcagttgaatattcattgtaaaagccatgcaggcacctcctgattcttgccggatatgatcgcttccaaagttccattcgtatctactatctattataagcgaaactgggaggaaaaactaccagttttgatgaatgactggtggaatcagcggcataatggtatgatataggcagcaagtctgcataaataagaacatagaaagagagtgaaaagcctatgattaattactctgaagataaggacaggcagtatcatatccaggtagcgcaaggagaagtgggaagatacgtgatcctaccgggagatccgaaacgctgcgcaaagatcgcggaacactttgaggaacccaggctcatagctgacagcagggaatatgtgacctataccggctatctggaaggggaaaaggtaagcgcaacttccaccggcatcggagggccgtccgcgtccatcgccatggaagaacttgcaagagtcggagcggatacatttatccgggtaggcactagcggcggcatggctctggatgtaaagagtggggacgtggtgatcgcctccggggcaatccggatggagggaacgagcaaagagtatgcccccatcgaatatccggcagttgcggacatccaggtgaccaatgccttgatccaggcagcaaagaagcaggggcaggattaccacgtaggcgtggtgcagtgcaaagacgctttctatgggcagcattcgccggaaaccaagccagtgggctatgagttgaagaataaatgggatgcctggatcaaatgcggatgcctggcatcagagatggagtcggccgccctatatatcgtgggcagctgtctgagagtcagggtcggcacggtgcttttggtgatggccaatcaggagcgggcgaagaagaacctccccaatccagtggcacatgacgtggaggcacctatccgcacggcgatcgaggcgcttaagacgctgatcagagaagataagaagcaggattaaggaggaaggatatatgggaacaccacataatgcagcagaaaaaggagagatagccagcacggtactgatgccgggagacccgcttcgggcgaaatacatcgcagatacttatctggaagatgccaggtgctttaatacggtgcggaacatgctgggatatacaggaacttataaaggccgggaaatctcagttatggggggcggcatggggatgccgtccatcggaatctatacgtatgaactttatcataggtatgaggtggaggcaatcatacggattggctctgccggcgcgttaagggacgatatccagttgaaggacgtggtgatcggcatgggagcctgcacggattccaattatgccgcacagtaccagctgcccggcacatttgcgccgatcgcagattacaggctgcttgagaaggcggtgaataccgcaagggtccaaggagtcaacgtgaaggtgggaaatatcctgtcctctgatattttttacaatgatgacgatgaagtaaatgcgaaatggaggaaaatgggcgtgatggctgtggagatggaagcggcggccctctatatgaacgcggcccgggcagggaagaaggcgttatgcatgctgaccatctcaaaccatctgttccggcaggagagcataagcgccagcgaacggcagtcaggattcggacagatgatggagatcgcgctggaattataacagtacaaggaaaaggagtgttggatgatatggagatacaggagatattaagacatgtggatcatacattgctgtcacagacggctacgtgggaagagatcaagacgctgtgcgacgacgccatcgcctatgggaccgcatcggtatgcattcccccatcttatgttaagcaggcaaaggcatatgtaaaggaacgcatgacagtgtgcacggtcatcggctttcccaatggatacaataccacggctgccaaagtatttgagaccgcagaggcggtaaaggacggcgcggacgaggtggatatggtcatcaatatggggtgggtcaaggaccgggagtatggccggatcacgcaggagatccgatccgtcaaagaggcggccggcagccggatattgaaggtaattatcgaggcctgcttccttaaggaagaggaaaagatacggatgtgcgaggccgtgaccgaggctggtgtggactttatcaagacctctacgggatttggaagcggaggcgcgacgtttgaggacgtgagattgtttgcgcgccatgtaggagaaggcgttcagattaaggcggcgggggggatcagttccattgcggatgccgagaaattcctaaggcttggcgcctcccgcctggggaccagccggattgtcaagattgcaaagaaagagggacttagggaatgaagttacaggaaagcatgagagaggaactgatccgccgggcatttggagtactggaatatgcctatgctccttattctaaattcaaggtggcagcagccctccttaccaagagcgggaagatctatactggctgcaatatcgaaaatgcggcgttaagcccgggaaactgcgcggagcggactgcgatcttcaaggcggtaagcgagggggagaaagactttgccgccatctgcatcgtgaacgaggatgcgcaggggaatcatgactactgcccgccctgcggcgtgtgccgccaggtcatgatggaattctgtgatcccggcgaattcacgattattttggcgaaggacgaaggcgattatcaggcgcatatgctggcagaattgctgcctctcggatttggccccgggaacctaaaaaaacagacagatgacgatttagttgattaaagtcttgaaacaaccattaaaataggatattatatgttctatagatttttttaacagaggaaggaaaatgaatatgaacctgaatattggagtgataaaaggggatggaatcgggccggagattgtgacggaagcaatgaaggttctggataaaactgcagagaaatacggccacgcctgcaagtatacccagcttttgctgggcggggcctccatagacgtacatgggattccgctgactgacgagacggtgaagcaggcaaaagcatgcgacgcagtgctgatgggctccatcggaggagatgcaaagacttcaccctggtatcagctggaaccgtccaaaaggccggaggcaggacttttaaagattcgtaaggaactgaaccttttcgccaacttaaggccagccatcctgtatgatgaactgaaggacgcatgcccgctaaaggaagagattaccgagggcggatttgacctgatgattatgcgggaactgaccggcgggctgtatttcggagagcgcaggacagaagagatcgacggcgtcctgactgcctttgactcccttacatataatgagaatgagattcgccggatcgcaaagcgggcgttcgatattgccatgaagcgcggcaggaaggtgacaagcgtagataaggcaaacgtgctggattcctccaggctctggagaaaggtcgtggaagaagtggctaaggattatccggaggttgcgctggaacacatgctggtagataattgcgcaatgcagctggtgaaggatccgaagcagtttgacgtggtactgacggagaatatgttcggcgatatcctgtcggatgaagccagcatggtcaccggctccattgggatgctggcaagcgcgagcctgaatgagaccaagttcggactctatgagccaagtggcggctcagccccggacattgccggcaagggcattgccaatccaatcgccactattctgtccgcggcaatgatgctgcggttcagtttcgatctggaccaggaagcagatgcgatcgaggaggcagttaacaaagtcttaaaagaaggctgccgtaccattgatatcatgtcagagggcaagacccaggtaggaaccgcggaaatgggaagcctgatcgcggagcgcatataacaggtacaaagacgagagaaagcaaggatagcataagatatagacagatagagaaagattcaggaggtagtaggatgaaaagcgatacagttacaaagggaaagcagcaggcgccccaccgttcattgttgaacgccctgggcctgacgccggaggagatggagcggccgctggttggaattgtcagttcttataatgagatcgtgccgggtcatatgaacctggataagattgtaaatgcagtgaagcagggggttgccatggcaggaggaacgccgatcgtatttccggccatcgccgtatgcgacgggatcgccatgggacatatcggcatgaaatattctctggtaaccagagacctgattgcggattccacggaagccatggctctggcccaccagttcgacgctctggtcatggtgcccaactgtgacaagaatgtgccgggacttttgatggcggcagccagaatcaatgtacctaccatattcgtaagcggcggccctatgctggcaggccatgtcaagggaaagaagaccagcctttccagcatgtttgaggcagttggagccaacgcggcgggtctgatcacggacgatgatcttctggaattcgagaataagacctgtcctacctgcggatcctgttccggcatgtacacagccaacagtatgaactgtctgacggaagtacttggcatgggacttggcggcaacggaaccattccggcagtctactctgcaaggatccgacttgcgaagcaggcaggcatgaaggtcatggaactgtgggagaagaatatccgcccaagagacattatgacagaggatgccatcctcaacgcgctgacggtggatatggccctgggctgctctaccaacagcatgctgcatcttccggcaatcgcccatgagattggcatggattttgagattgactttgcgaatggaatcagcgaaaagaccccgaacctctgccacctggcaccggcagggcctacctacatagaagacctggatgaagccggcggcgtatatgcggtgatggcggaactgaataagaaagggcttctccataccgactgcctgacggttaccggcaagacggtgggtgagaacatcaaagacgcggtgaataaggatccgcaggtgatccgacccattgacaatccatacagccagacgggaggacttgcggtactcaaaggcaatctggcgccggatggcagcgtggtaaaacgctctgcggtcgtagaagagatgctggtgcatgttggcccggcaagagtatttgactgcgaagaggccgcaatcgaagcgatcaaaggcggcaagatcgtggcgggagacgtggtagttatccgctatgtgggcccgaaaggcggtccgggcatgccggagatgctgaatcccacttctgccatcgcaggcatgggacttggatccagcgtggcgctgatcacggacggacgcttcagcggagcctccagaggcgcatccatcggccatgtatcgccggaagcggcagtgggaggcccgatcggactggtggaagaaggagacatgattaagattgatatcccaaacctgaagttggaactggatatatccgaggaagagatggcgaagagaaagcaggcatggcagcctagaaagccgaaggtaaccacaggatatctggcaagatacgcctccatggtaacttcaggaaacagaggagctatcctggaaataccgaagaattaagatagaataggagaacaaaaggtatgcaattaacaggatcagagatagtaattgaatgtttgaaagagcagggcgtggataccgtgtttggctatcctggcggggctattttgaatgtttatgatgaattatataaacatagcgatgagatcacccatattctgacctcccatgagcagggagccgcccatgccgctgacggatatgccagggcaacgggaaaggtaggcgtctgcttcgccaccagcggcccgggagcgacgaatctggttacgggaatcgcgacggcttacatggattctattccgatcgtagcgattacctgtaatgtaggcgtgtcgcttcttggaaaagacagtttccaggagattgatattgcaggtatcacgatgccgatcacgaagcataactttatcgtcaaggatgtaaaagatctggcggagaccataagaaaggctttcgtgatcgcgaagaaagaccgtcccggcccggtgctgatcgatatccccaaggatgtgacggcgaacaaggcagaatataagaaagagtctatcaagcctgtcgagccttccagagacatcttcgaagacgatattcagacggcattaaaaatcataacaaaagcaaaaaagccatatatctttgtaggaggaggcgcggtactctcaggcgccagcgaagaactctatacatttgccaagaaggtggatgccccggttacggattccctcatgggcaaaggcgcatttccgggcaccgatccgttatatacaggcatgctgggaatgcacggcacgaagacggctaactatggcgtcagcgagtgcgacctgctgatcgtcatcggagccagattcagcgaccgcgtgacagggaatgccagaaagtttgccaagaacgccaagatcctgcagtttgatatcgatgctgcggagatgaacaagaatgtactgatcaccgacggcgtagtgggcgatatcaagaccgtgctgggtatcctcaacgagaggctggagcagcaagatcatgcggaatgggtagagaagatcatggattacaagaagagatatccattatcctatcatccggacgtactgaccggcccatatgtggttgaggaaatctacagacagaccaagggggatgccgtcatcgtgaccgaagtcggccagcatcagatgtgggcagcccagttctataaatttacaaagccaaggacattactgacgtccggcggcctgggaaccatgggatacggcctgggagcctccatcggtgccaagacgggactgccggatcggacagttgtcaatatagcaggtgacggatgttttcgtatgaatatgaacgagatcgccaccgccgtgcgccacagtattccaatcatccaggtagtcattaacaaccacgtgcttggaatggtgcgccagtggcaggatctgttctacggaaagcgttactcggcgacggttctgaatgacgccgtggacttcgtgaagcttgcggaggctatgggggcaaaaggaatccgtgcaaccacccaggaagaattcaaagaagcattcgaaaaggccctgactcttaacaggccggtcgtcattgactgccaggtggacagcgatgacaaagtatggcccatggtagccccaggcgctccgatcaacgaagcattcgatgaaaaggacctgaaaaaacagaaataacagaacaagggaaatggaggaacaacaatgagcagagtgtacaatttttcagcaggaccggcagtattaccggaggaagtattaaaagaggcagcagaagaaatgctagattacaacgggaccggaatgtccgttatggaaatgagtcaccgctcgcagtcgttccaggaaattattgatacagcagaggcggatcttcgggaattgatgggcatacctgacaactataaggtattattcctgcaaggaggggagtcccagcagttcgccatggttcctatgaacctgatgaagaacaaggtggcagactacatcgttaccggacagtgggccaagaaggcagccgccgaagcaaaaaaatacggaaaggtcaatatcgtggcatcctcagaggataagacattctcctatatcccggattgctctgaccttcccatttcagaagatgcagactatgtgtacatatgtgagaataataccatctatggcaccaaatacaaggaacttccgaataccaagggaaagaccctggttgccgatgtatcatcctgtttcctgtcagagcctatggatgtgacccgatatggcctgatatgcggaggcgtgcagaagaacatcggtcccgccggaaccgtgatcgtgatcatccgagaggatctgattaccgaggatgtgcttccggggacgcctaccatgctccagtataagacccatgcagatgccaagtctctttacaatacgccgccggcgtatggaatctatatctgcggcaaggtattcaaatggctgaaaaggcagggcggccttgcggcaatgaaagagcgcaatgaaacgaaggcgaagatcctgtatgactatctggatcagagcaggctgtttaaaggcactgtggagccaaaggaccgttcgatcatgaacgtgcctttcgttacaggaagcagcgagctggatgcgaagtttgtaaaggaagccaaggcggccggattcgagagcctgaaaggacaccgctcggtgggcggcatgagggccagcatttacaatgcgatgccgatggaaggcgtagaggcactggtggcatttatgaagaagtttgaagaggagaatgcatagttatgtataaatattattgcttaaatcaaatatccgaagtgggtatgaaacagtttacggaagattatgcgccggctggcggtccaaagagcgcggatgccatccttgtaagaagcgcgaacatgcatgagatggagtttggtcctgaattaaaggcgatcggaagggcaggcgcgggggtgaataatattccccttgaaaaatgcgcggaacaaggaatcgtggtattcaatacgccgggagccaacgccaatggcgtgaaggaactggtgatcgcaggaatgctgctggcttccagggacatcatcggcggcatcaactgggtgcaggaaaacgaagaagacggcaacatcgtaaaagagacggagaaggccaagaaagcatttgcaggctacgaactggaaggcaagaaactgggggtcatcggccttggcgccatcggcgtgctggtggccaatgcggccatgcacctgggaatggatgtctatggctatgacccgtatgtatccattgattccgcgtggagactgtcccggaatatcattcatgcaaaaaccgtggatgaactgtataaagagtgcgacttcatcaccatccatgtgcccgcgcttgagagcacgataggaatgatcgacagagatgccataagcctgatgaagaaaggcgtggtagtcctgaatttcgcaagagacctgctggtggacgaagaggctatggttgacgcgctggtagccggacaggtaaagcattatgtgacagactttccgacgcctgtcatcgcaggggtaaagggagccattgtaatcccgcatctgggcgcttcgacggaagagtccgaagataactgcgccagaatggcggcaaagcagatcagggcctacttggagcatggcaatatccagaactccgtgaattatccggacagcgatatgggattgaggggcaagaataccaggatcgtccttctgcatcacaatgtgccgaacatgatcggacagtttacgaagatcttggcggatgacaatatgaatatcgcagacatgagcaataagagcaagggcggctatgcctacacgatgatagacatcgacagcccggttcctgagaaagtggtggatgatctgaggaaggtcggcgaagtactgcgcgtgcgcgtaattgaataacgggtaataaatttaacaattattaagaattgttcatataagattcattgcgaaacgtgtcgaattacgttatactcaactacatagatggatgtttgatgatgtgtaggggagacatacggatgacaaatgaaagaattagcgagcacaagaagcatatacataaaaaagcaagaagagtaagagtccctttgcggatttttgctctttttgtagtttgcgctcttccattctttctttttcggactgcggcggcatcccagcaggaggcggagatattccttgcggtaaagagcaattctatattgcagggggaagaccttcccaagttcgggatcacggtagagaccaaggggaatacgaaggccgtgctggatgcaaaaaccggctatacagtaagcgacctggcaaaagatctggaacatgggaagcgctatgccatcggctgcgaagcggatacggctgtggaaggagattatccggtaaccctgacgctggaggatgcggtcagaggattcctggaaaaggactggatcgggctggtcagaattgatactgccgatggcgtcctgacaattaagaataaagtcggagagtgggagggggacaagtttaagcgctatgatggatcctatgtcactgatgacttcgtagtctcaaaagggaacacctattactttgacggagacggcaagaaggcgtccggctggcaggatatcaacggttccagatattactttgacaaagatggaatgatgaagaccggatggcttgacagcgatgatggaaagtattacctgggtgcggacggcaaggcttatatcggctggcaggatatcgacggttcctcctattactttgaacaggatggcaagatggcgacgggagaggtgtggctggggcttacgctgtgcgtatttgatgagaacggcgtgcttatctccaagaaggagagcgccatagacccgaacaagccgatggtggccctgacctttgacgatggccctggcccgcgcaccggcgaactggtggaggcactggcgaagtacaatgcccatgccacattcttcatgcagggaaagaaagtgccatcctatccaaatgtgatccagaagatgagggaggtgggctgcgaactgggcaatcattcctatgaccacgcagatctgtcgaaactggatgcatccggcatacagaatgaaataggagggaccaatggcaatctccagaatatcgtagggcagggagccaccctgatgcgtccgccttacggggctatcagttctacgatgaaaggaaccgtgggaatgccaatgatcctgtggaatatcgatacgctggactggaagaccagaaatgcgcaggccacgatcgattccgtcatgggaagcgtaaaagacggggatatcatcctgatgcacgatatccatacggagagcgtggacgcagcccttgcactgataccgaaactgatagatgagggataccagctggtaaccgtctccgagatggcgagagccaaaggagtcgaactgaaggacggagttagctatacagatttctagtcctttcggaatagaaaaagaatgttaaaaaatacacaaaaaagtatggaaaaattagaagatctttgttaaaataatatctttacaaatggagtgctaggtgttaatcttttaacggaataagatatacgaattcagtatgaaggaagtgagttttgatgaaaggtttattcgcagcactcaaggaatactttaccgaagaaaccgctttaaccacatatatggagcagcgctaattaagaaagtattgagaggaacataaaaggatgtctcgtctaagtggatgagacatcctttttatctgcattataaaagatatgagactgcaaagtttgttaaattaattacaaggaattgcggtgcttttccaataatttgtgaatcttgtctgtcggattgaggacagcgccgatggaaatatcgtggttgaatgaatcgataatcagcgcgatatatttgctcatatccgcaattacaaaataaggcttttcatgtacggccggaggaagataagtaaggttcgtggtaatcacgcggtcgatgtagcccttttcataatattcatcaaacatatcaaatccttctgtgaacaatccaaaggaagtgcagacgaatacccggtccgcgcctctgtccttgatctgtcttgcaacatccagcatactttccccagaggatatcatatcgtccacgataatgacattcttgcccttgatatcatcgcccaggaattcatgggccacgatggggttcttgccgttgattacggtagagtagtcacggcgcttataaaacattcccatattgacgccgagaacgttggagaaataaacggcacggtgcattgctccttcgtccgggcttaccaccatcaggcgctccttatcgacgatcagttccggctctgcccgaagaagggctttcatgaactggtaaggaggattgaagttgtcgaaaccgtgcagcggaatagaattctggactctcgggtcatgggcatcgaaggtaagaatattggtgacgcccatgtcgaccagttcctgaagcgccagggcgcagtccagggattcgcgcttcgtacgcttgtgctggcggctctcatacaagaacggcatgatgacattgacacggtgagccttgccgttggccgctgagataacgcgttttaggtcttgatagtggtcgtccggggacatatggttcaagtgaccatttactgtataggtcaggctgtagttgcagacatcgaccatgatgaacagatcttttccgcggatcgactctccgataattcctttggcctccccggttccgaaacgggggcagtggcagtcgatcaggtaattgtccagctgataactggaaaaaagcggcgaatccaaagattcttttaacgtatcctgcctgaatctgacaatataatcatttactttctggcccatcaccttgcatgagtcaagggccgcgatctttaggggcgctacgggaagcgccgtctccattaacttaatatttggcatgataatctcctgtatctttcgaatttatagtaatcactattaatatttatatcacttttcctataaaaaggtcaacaacagattggactatttgggaaaggtaatgtataatggagtatggtcaacgaagaaagtaagatagaggagatataaaatgagtaaaccagtagtagcaattgtgggaagacccaatgttggaaaatcgaccctttttaatgtattggcaggtggtatgatatccatcgtcaaggatacgcccggagtgaccagggaccgtatctacgcggatgtgaactggcttgataaggacttcacgctgattgatacaggcgggatcgagccggagagcaaagacatcatcctgtcccagatgcgcgagcaggcacagattgccatcgacacggcagacgtgatcattttcattactgacgtgcgccagggactggtagattcggattcaaaggtggcggacatgctcaggcgctccggcaagccggtagtcctggtggttaataaagtagataattttgacaagttcatgccggatgtatatgagttctataatctggggatcggcgatccggtacccatctctgcggcgtcccgcctggggatcggcgatatgctggatcaagtggcggagcatttcccggagcatggcagggaggaagaagaggatgagcgtccaaggatagcgatcgtaggcaagccgaatgtaggaaaatcctccatcatcaacaaactcttgggagagcagcgcgtcatcgtatcggatatcgcgggaacgacccgggatgctatcgacacagatatcgtgtacaatgggaaggaatatgtattcatagacacggccggccttcgcaggaagaacaagattaaagaagaactggaacgctacagcattatccgtacggtaacggcggtagagcgggcagacgtggtgctgatcgtgatcgatgccaccgaaggcgtgacagagcaggatgcgaagattgcgggaattgcccatgagcggggcaagggcatcatcatcgtggtaaataaatgggatgccatagaaaagaatgacaagaccatgcgggagtatgacagtgaagtccgtcgcgtgctgtcattcatgccttatgcggagattatgtatgtatctgccgagacagggcagcgcttgaacaaattatatgataagatagacatggtaattgaaaaccagacgctcaggatagctaccggcgtgctcaacgagatcatggccgaggccgtggcaatgcagcagccgccgtcagacaaagggaaaaggctgaaactgtactacattacccaggtggctgtgaagcctccgacattcgtcatattcgttaatgacaaggaattgatgcatttctcctataccaggtatttggagaataagattcgcgaggcatttggattcagaggaacttcgctgaagttctttgtacgggaaagaaaggataaggagcgctagttatggaacgtttcatatgtgtgattataggatacgcatttggattattgcagacaggatatctgtacggcaagctgcaccacgtggacatcagaaagcaggggagcggcaatgccggaaccaccaatgccttgcgcactatgggctggaaggcaggccttgtgacgctgctgggcgactgctttaagtgcgtgttagcggtggtcgtggtgcatctgctctatggaaagagccatgcggacatgatgccgcttcttgccatgtatgcgggcatgggggtcgtgctgggacacaattacccattctacctgaaattcaaaggaggcaagggaattgcagctacggcagggctgatcgtaagcaccaccaatgtgtggatggtactgatctgcctggcggctttcgtgggagttgtggggatcaccaggtatgtgtcgcttggctctcttttggtggtcgtcatctatcttgcggaggtggtgatctacggacagatgggaggattccatgtagcgcagaattatctctacgaaatgtatgggattgcggcatttttgatgctgtctgctttctttaagcacagggagaacattaagagactattaaccggcacggagaataagctaagtgtcggcaagaaatagcacaaagtatgaaaggaacgtaaacattatggcaaatgtaggtattatgggagcaggcagttggggtaccgcactggcgcttctgctccacaagaacgggcacaatgtgacggtatggtccatcaatgacgacgaagtgaagatgctttccataaaacgggagcatgagtccaaactgcctggcgtaaagattccagatgatatggagtttacatcggagatggaatccgccatcaaggggaaagactttattgttctggctgtgccgtctccatttacacgcagtacggcgcgcaatatgaagccttatgtagcagaggggcagattatcgtggatgtggcaaagggaattgaagaaagcactctgatgaccctgtcccagcagattgaagaggagatcccgcaggcgaacgtggctgtattatcgggccccagccatgcggaagaggtaggcagagggctgccgaccatcgttgtgatcggcgctaagacgaaggagacggcagagtatctgcaggatatgttcatgaacgaggtgttccgcgtgtataccagcccggatatgctggggatggaactgggcggatcgcttaagaatgtcattgcccttgcggcaggcatcgcagacggcctgggctatggagataacacgaaggcggcgcttattaccagaggcattgcggagattgcaaggctgggtgtcaagatgggcggagcaattgagagttttacaggcctgaccgggattggcgatctgatcgtaacctgcgccagcgtgcacagccgtaaccggaaggcaggctatctgattggacagggaatgtctatgcaggaagccatggacgaggtcaagatggtggtagaaggggtatattctacaaaagcggcagtcaagctgggcaaggaatatggagtttccctgccaatcatcgacaaggtcaatgaagtcctcttcgaaggaaaggatccgagagaagcggtcaatgaactgatgctaagagacagcaaggccgaacatacggcgctgccatggaaagaataggataaggcatagtaaggcacccggtacagattcgatgtaccgggtgctttactatgcccaaaagtgtattccaatagggatcagagatccgcatgctccattacgtatttcttgaattcatttatgaccggcgcctggtagacattcttgagagtagccatgtagaagatcctctcccaggtaggcttttcaatctgtataatcttcaccggcatatagttaagcaccggcatattggggaccacggcgatgccaaatcctgctcccgcaagcccggccacggcttggtcttcttccaccgaatatacatattccggacggccgccgcatttgtcgaacagcttgtctatcacaggccgcaggccgctgcgccttgagaaggcgatctgaggatattcaagggtttccttaaggtctatgcgatccctggactcaagcggatgtccattcggtacgaccaagaccagttcctggcgggcgatcggcacgaactcaataagcggctcatgatccagcatggaacaaaaggcaacgtcgtatttccggtctttcaggccctggatcatgtctgtagacatgcctgtggagccatgaaaatggaagtcgatattcttgtccggcttggaatccaggaatccttttacgaagccggggacgatgatgctgctaagcactctgagctggacgatgtcaatacgtccttcgccgcttccggtcatctgcagtttgttgacgctggaatccagcatatcaagcgcacgttccacatcagtcagaaaagcctggccacatttggtcaggacaacgttgcgtccttctttttcaaataactttacgcccagttccttttccaaggatgcgatggcatggctaaggcttggctgggtaatggctaatatttctgcggccttggtataatgctccagatgtgccagcgtcacaaaatatctgaggtggtaaagattcattatgatgatttctcccttgttttctgattttgactatattctaacatgaactataaacaaaatctatggattcggtcaatattaacaatttgtttttaatttaacaatggaatataatcaaagcatagtaaaaatcacaagattgaaccagaaaaatagaagaatcatgttcaattttaacaatggaaggagaaacgtattatgtcaagaaaaaatccaatcacagtaagttcatggacattgggagaccagtgcaaatttgaggaccgggtcatcgcagcgaaagaagctggttatgaaggaatcggcctgagggcagagacctatgtggacgcgttgaatgaggggcttcatgatgaagacattttagcaatcctggataagcacggaatcaaggttaccgaggtagagtacatcgtacagtgggcagaggagaaccgttcctacgagcagaagtacaaagagcagatgtgtttccatatgtgcgaactctttggagtaggccatatcaactgcggacttatggaaaactattctgtggagtatacggctcagaagttaaaagaattatgccagagggccggaaagtacatgatcggagttgagccaatgccatacagcggtatcccggatctcaaaaaaggatttgatgtagttcaggcatccggatgcgacaatgcgatgctgatcctggatacatggcactgggtaagagcagaccagtcctacgacatcctgacagaagagcaggctaagaaagtcatctccatccagatcaacgatgcttacgagaggccatatgcaaagacgatcttaagagacgaatccatgcatgaccgtctcgcgccaggaaccggagcaaaggatacggcagggtttgtaaagatgatcaaggaagctggaatcgatcctaaggtggtaggcgttgaggtcatctctgacgagatcctgtcaagaggcctgaaagaagctgcagcccatacctatgacaataccgtaaaagtattgaaggaagcatggccggagattctggaagactaagagatacctgatacataaagagataattcttgtgacaagcaataaatcgagagcgaggaaatgatatgaaatttgaaaatatgttcaagccaatccagattggaccaatgactgtaaagaaccgtttcgtagtcccgccgatgggcaataacttcgcaaatgcggatggatgctggagcgatcagtctgtcgcatattatgcagaacgtgcgaaaggccagtttggcctggttaccatcgaggcgaccgttgtacataaaggagccaagggcggcccgagaaagccttgcctgtacgatgaaagcagcatcgcaagcctgaagaagattacggatgcctgtcatgcaaaaggtgccaaagtttccatccagctgcagaatgcagggccggaaggaaatgcaaagaatgcaggcgcgccaatccaggcggcaacagccatcccatctacggtaggaagagacacgccggaagaagtgcctaccgcgcaggtatatgaactggtagaaggctatgcagaggcagcaagacgcgctatggaaggcggtgcggatgccgtagagattcatatggcacacggctatctggtaagttccttcatgtctccaagaaccaacaagcgcgtggatgagtttggcggaaacttcgagaacaggatgcgcttcccacgcctgatcttggaagcggtgaagaaggcggttggagacaaggtggcgatcatcgcccgcatcaacagtgccgatgaagttctgggaggactggatgtacatgacagcgcggccatcgcggcatatctggaagaatgcggcgttcaggcgcttcatgtatcccgcgcggtacatatcaaagacgaatatatgtgggcgccgacaacgatccatggcggattctcagcagatctggtatccgagatcaagaaggcagtcagcattccggtgatcacggtcggaagattcacagagcctcagtatgcagaacttctggttaaggaaggccgtgccgacctggtggcattcggacgtcagtcactggcagatccgcatatgccggagaaggcaatggaagaaaggcttgaggatctgactccatgcatcgcctgcctgcagggatgcgtggccaatatgtataaaggagagcctatctgctgtctgaccaacccattcctgggccatgaggcagaagggtatccgaaggcagagaagtctaagaaggtcatggtcattggcggcggcgtagccggcatgtgcgcggcattcatctgtgcggaaagaggccacgacgtaaccttatatgagagcacggataaactgggcggcaacatgcgcctggctgcgtaccctccgggaaaaggcgacatctccaacatgatccgaagctacatcgtaagatgccagaaggcaggcgttaagatcgtgatgaatcaggaagcagacctggatcttgtaaaagcagaaaaaccggatgcagtcgtagtatccaccggctctaagactttgatccttccaatcgagggaatcgacaatccggcaatcatccacggctccgaccttctggatggcaaaaaagcggcaggagaaaaggttctggtagtcggcggcggaatggtgggatgcgagatcgcagccttcttaggagagcagcagcatcaggtatccatcattgaattccgcgacaagatgggcgcagacatgatcaccgagcaccgcaaatatgtgatgaaggatttcgatgagtataaagtagagcagattgtaaatgcaaaagtatgccgtttctatgatgacggcgtggaatatgagtctccggacggagaacggcatgaggtaagaggattcgactctgtcgtattatccatgggattcagaaactacaatccatttgcagaacagctggaagagttaggacaggaagtatatgtcgtgggagatgccacaagagcgcgccgggcactggacgctactaaggaagcatacgcagcggcaatgcagatataaggaggaaatataagacgatggaaaagagaatatccggacacacaggattaatgggactatttggaacgccggttggacattcaggatctcctgcaatgtacaacttcagcttccagcatgacgggctggactatgcatatctggcatttgacgtgacagaagagcagatgccaaaggtatttgaaaccatccgcctgctgaatatgcgcggaggaaactttacgatgccttgcaagaacattgcggcagagctggtagacaaattatcaccggcagccgagatcatcggagcctgcaacgtattcgtcaatgacaatggcgtgattacgggccatgtgacagacggcgtaggattcgtaaaaaatctggaagtcaacggggttgacgtaaaaggtaaaaagacggtagtattaggcgcaggcggggctgcaacggcaatccaggtacagctggcattagacggcgcaaaagaagtagccatcttcaatgtcaaggataaattctttgacagggccgagggcaccaaagataagcttgccgagaaatgcccggagtgcgtcgttacggtgaatgacctggaagacaagggaaaacttgccgaggcagttaataactgcgatatcgtcatcaatgcgacgacgatgggaatgaagcctcacgatgatgtctctctcatcgacaagtccttataccgcaaggatctggtcgtggctgataccgtatacagcccggagaagactaagatgatcctggaggcggaagaggcaggatgcaaggcgattggcggaaaaggaatgctccagcagcagggagcggtgaactacgaactgttcgtaggcaagaagatgccgcttgaggaatacaacaaattccaggcagagcaggccaaatagcagtattcagcagtattcaaaagagaatgatagagaaaaggagaatgagaggatgagagcaaagaagtatattctttctatggctatggtatacatggcatattttacccatggcatccaggcgattattctgtcacagaataaagtaaacttcttcacccaatggggatatacagacgaagtggcaggagcagcagcggtgtctctggccatcacggcgacaggtttcggaaaattcctgaccgtgtggcttggcggagagatatctgataaaataggacgtaagaaaatggcggttgccggaggcatactctatatcgtgtgctttgcaggcctgctgttctctacaaactttacggtagcatgtgtatgcgccttcctggcaggcgtggcgacttccggattctgggatgcatccttgtatccggcggtacaggaagccgttgagccaagatatgccggttctgcgttaatcggaatcaaggcattcgtatccgtatccggcattatctacccattgatggccgtacatttttccaattccggaaactggcacattaatgtatggattccgcttgtgatgtccgttgtatgcgtcgtactggcagtcattgctccatttgcctatgacgatgatatgaaagagacggtaaagaccgcggatggcgagacgaagaacgccgcccaggccgagatcgacgcggcaaaagccagcatgctggttaagccgaatggattggtaaactttattaccatgttctatggattcctgtgcatgttcatcatgtatggcgcgcagcagtatactaaggcctttggcatgacaaactgcggactgacggaaatgcaggcggcaggcatgacatccatctatacggtgggctccatcattgccgtagtattctgggcaatcatgatgggcaagttgaaatggaatccgctaaaggtagttctgattgattcgatatttacagcggttgcgctggcaatcgtgcttcttgtaaagaacgtaggagtcatctatgtagcgattgccctgcttggattctttgcggccggcggagcacttcagacaggacttggcgtacgccagttgatgtgtccgggacctaagggcaggaataccggaatctactacacatggatggggcttgcaagctgcttccttccatacatcgtatccgcaatgaccaagtctatcggcgagacatcagccatttacacgatgatgggcctgctgcttgcagcatccgttatcgcgacggtgatgatgttctatctgataggacagcataagaaaatatttggaaagagcgcattgttgaaataatccgtgcgtcactctgcctttggaaccaaaggcagagttccttattgacttggtttgttaaaaaatagacgaaagaagattaaggagggtactcaatcatgagtgcaagaagagcgagaaaaccaaatgaactcccttatattcctcttgggcctttccaatggagaatacccggcgtacattaccgcgttgaatatgtggagttctttcaaggactgatcctgggagcgacagcccttagttcaatcccatacttgacggactatctggggctgccctatgaactggcatggagttgcgttattctggaagtggccttatacatgcttcacggctggctgggagatcccgtggtgcctggctggatcacgccgacgctgccatttaccttagcgttcatcagcgggttcgaaaaagggccgcatcgcatccaggcgatgatcgccgtacaattattggtggcattcatattcttgtttatgggtgtcacgaaattggcagacaagtttgtaagaagcgttccgacctcggtcaaggggggaatccttctcgctgcgccgattaccgttattcagggacagttggcagaagacagccaactgctgacggctccggtagcgacgctggcaggaactctgcttttggcattcttaagtttctcacccttctgcgagaagaagagaggaaaatataagattctggatgtgatggctaagtatggaaacctgttcccatacctgatcgccatgcttcttggcgtggccttgggagaactggcgaagcccgttctggagatgggggcagtcattagaattccggatttttcgaatatgttccatacggttagcatattcgccgtaggattcccgccgttatccatgtttattaaggcattgccgcttgcactgatctgctatgtcctggcgttcggagactttgtaacaagcgagacgctggtaaaagaagcacaggagagcagggatgatgagtatatcgactttaattccagccgctccaacctgattagcggccttcggaacctgatccttgccatatttgcgccatttccgccattgtccggcccattgtgggttggcatgacggtttcggttgcaatgcgttacagggaaggaaagaaagccatgaagtccttgatcggaggcatgagttccttccgtatggctaccttcttaagcgtgatcctggtgccgatcgtatccttcatgaagccgatcatgggcgtaggatccgccatcacgctgctgttccaggcttatgtctgcgcaaggatcggcatggagtactgcaagtccaacacagacaagagcattgccgggatcatggccgcggtgctggcatttaagggttcaggctgggcgctcctggtgggctttgcccttaacttcattctgtccaacatggaattccagaagaagaaactgggcgtacctacaacggaagaactggaagccattgaccgcaagagagatgaggaaatacgccgcatggccatcgaaagaacggcagaagcgtggagagaggagtaaagcactcctcttataacgcctgatgcacggtgttgagaacctggtacagttcctctgcgccaatctggccgggagcggatgccttagagccggagccgaaggtcagacaggagccgaatacctcgcaggagatgcggctgatgctgccaagcccagacatagacatggtgatgatgggcctgtcagcgtaacaggaagccatctcttccgtggcggcaagcaaagtgaggacatccttgcggctctttggcataacggcaatctttggaatgtcagcctccatatcctgcattttgcgcagccgaaagacgatgtctgatttggccggcgttttgtcaaagtcgtggttagagccaatgactttggcgccacaggcatgaatggacgcgatcatgtcccggacatccttgtcgcctgcgaatatctccacatcaataaggtctgcatgacccgaggcagccactgccttgttgagtgcaatgtatttttccctggacatgccgtggactccgccttccttaaccgtacggaaggtggcaagaagcggcatgtcctttaatagacttctaagattcgatagcacgtccagtaccttgtccgtatcttccacatcttcgtaccagtccatgcgccattccatcagatccatgtgcatatccttatattgcccggccagagtcaggatctcctcccgggtctttcccacattgggaatgcagatggcggggatccccgagcctaattccagatttctaacttttactgtattcatagagtctctccttttcgttgctgaatctattgcttgtgctgctgttattgtaatatcaataggatgggaaagtcaaattacagttattcagagaaatgatagcctgcgcctataaaaaacttagtctaaaaccagaaattgcagcatacattgttatcagcataacaagggggtattagaatgaatacgtttcagttgtacaaagatatacaagccagaacaaatggagagatatacataggagtggtgggaccggtaaggacagggaagtccacatttatcaaacgtttcatggatatgctggtactccctcatatggaggatgagaacggcaaggcgcggaccaaggatgaattgccacagtctgcctccgggcgtacgatcatgaccacagagcccaaattcgtgccaaaagaagcggcgcagatcaagctttctgatgatgtgacagtcaatgtccgtctgatcgactgtgtcggctatatggtagacggcgcttccggacacgtggaaggtaatgaagaacgcatggtgaagacgccctggttcgactatgagatcccatttacaaaagcggcaaccatcggaacccgcaaggtcatccacgaccatgcgaccataggcatcgtggtgaccacggacggcagcattaccgatatcccgcgggagggatataaggaggcggaagaaaagaccatccgggaactgcagaacatcggaaagcctttcgtggtactggtaaattcaaagaagccttttaatgacgaggcaaggcaggcggcagaggaactggaagcaaactttggcgtaaaagccatgccggtaaactgcgaacagttaaaagaagaggatatctatcagatcatggaagcggtgctgtatgaatttccggtatcggaagtgcagttctttattcccaagtgggtggagatgcttccaagggatcataaaattaagcaggatatgctggtacatattaaagaagttatggatcggttcagcgagatcaaggacgcggccgcgggaatccagacgccggagagtccttatattgacgagatgaaggtagaccagatcgaaatggataccggatgcgtgaaggtccggatcagcgtggcagaccggttctactacgagatgctcagcgaactgacgggtacccatattgcgggccagtatgagttgattgcggccatgcgggatctgtctcggttaaaggaagagtatgaaggcgtgcgggatgcatttacagcggtacgcatgaagggctacggcgtagtcagccccaagaaggaagagatcgtgctggaagagcctgccatcatcaagcagggcaacaagttcggcgtaaagatccattccgaagctccgtccatccatctgatccgcgccaacatcgagacggagatagcgcctatcgtaggaagcgagcagcaggcagaagacctgatccgctatatcaaggatgccaaggagagcgaaggcggcatctggagtacgaatattttcggcaaatccatcgaagaactggtgatggacggcatgcagaataagatggcaatgatcaatgacgagagccaggaaaaactgcaggatactatgcagaagatcgtcaatgacagcaacggcgggctggtatgcatcatcatctaggcccggatgcaggttcatttgactctggacgtcaagttgtatatagtatacttatacaggagtgtccgggaagtaaaggtaaaaatggcgtcaggggtagaacctgacgcttttttttgctataataaccgggatagtctttacacaaatgagagaaggaaaagttatgagtgcaaaaatattaaagcagctggggatcatcctagcaatctgccttgcggcggaattcatcgtgtcgctgctgccaatcgcatttccaagcagcgtcatggcaatcctggttctggcgcttctgctgtttacgaagatactgaaagaagagcatatccgggagaccggggacttcctgctgtcgaatatggcgctggtgttcgtgccgatttcgatcggcatggtggaagatgtagggttgctgaaaggccagctggcgggattcttgatcgtggtgtgcatctcgctggtgatgacatttctgggaacttacgccagcgtgcgtatcgtgcagatatgcatgaagaggctggcgggaaagggaggacaggcagatgagtaatctatggtccaatcccttgttcggcattctgctgtcggtgatggcattctatatcggaggcgtggctgctaggaaggccaggacgccgatcgccaacccgctgctgatcgccatggtgatctgcgtgctggtgctcaagatcctgcatatatcctatgatgactacatggaaggcgcccagtttgtctccatgttcctggtgcccgtgacagccatgctgggactgtccatctaccgccagagaaaagtgctcaaagagcagttttttcccatcgtgatcggctgcctgatgggaagcctcctatctatgggaagcacggtggcattatgcaggctgctggccctgcacgcagacatgatgcattccctgcttccaaagtcggtgaccacggcgatcgcgctggatgtgtcatcccagcttggagggatagagtccattaccatgatggcggtcattatctgcgggaccggaggcgccatcctccatccatttatcatcaagatgctgaagttaaaggatccggtagccatcggcgtggcatttggaacggccagccatgcgatcgggacgtccaaggcgcttgagatgggggaagtagaaggggccgtaagcggagtggcaatgggagttgcaggaatctgcaccgtaatcattgcattattattgtaaaagggttaatattctaatagaaaacaacagagaaaagtatggaggtacagtatgagggtcgcaattattacagcaaacacagacatatacagagacagggaagaaaatgaaagtggagaagtaattaagaagattgtagaggaggcaggacttgagatcgtattcatgagggcattgcctacagaccggaaggtactgtcaacagtgatgcagaggatggccgacaatcatctgacagacttgatcctgaccacggggggcgcaggatgcggtcctatggactgcacgccggaggcaaccatggacgttgttgaaagacctcttttaggaataccggaggcaatgcgggcgcacaccatgaagctgaccaagcgttccatgctcaaccgggccgtagcgggaatccgccaggatgtgctgatcgtgaatctcccgggcaaggccggggcggtaaaggaaagcctcagatatctgcttcccgaactggtacatgctgtgaacgtgatcaagggagaggcataagaaatgaaaattacgtatctggaacacagtggttttacaatcgagcatgaagacgtggtcatgatatttgattactataagggacggcttccagatatgcctgcagagaaaaaagtgtatgtattcgcaagccatgggcattatgatcattttaagagaaagatattccagtggtcggatgcatatgagaatatcaaatatattctgtccagtgatattacggaccgggggccgaaaggcagaacgatttatctggagccccgtaaggagatacaactggatgggatgaagatccggactcttcgctctacggatgagggcgtggcgttttttgtgcgcctgaaggagatgaccatatttcacgcgggggatctgaactggtggcactgggaagatgaaagcgagacctacaatgagatgatgcgccgcaattaccagtatgagataggcaagatcgagggtgaaaagattgacgtggcgttccttcctctggatctgcgccaggaggagcaattcttctgggggatggattatttcatgcgccatacggatacaaggcatgtattcccgatgcatatgtgggggagatacgaggcttatgagcgcctgatggaacggccggaatcggaaggataccggcagaaggtcatgcatatcaccaggacgcagcaggtgtttgaactggaagagaggaaggagtaggaagatgcaggtaaagatatatacggacggggcggcgaggggcaacccggatgggcctggaggctacggcacggttctggagtatgtggattccaagggggaattacatacccgggaactgtcccaaggctataagcggaccaccaacaaccgtatggaactgatggcagtgatcgccgggctggaggcgcttaaccggccctgccaggtggaactgtactccgattcgaaatatgtggtggacgcattcaaccagcactggattgacggatggatcaagaagggctggaagaggggaaagaatgagccggtgaagaatattgacctgtggcagaggcttctgaaggcgaaagccccccaccaggttcagttcatctgggtcaaaggccatgacgggcatccccagaatgagcggtgcgatacattggcaaccacggctgccgacggggatgcgctgatcgaggatgaagggactcccgtgtaaataatatttgttttttggaaaaaattatgatatagtaaccaaggcaagtaagacaagtaatcgcagctgcaagcgccgaaaggccgcaggtgaggaaagtccgggcttcacagggcaggatgccggataacgtccggtggaggcgactccaaggccagtgcaacagaaatataccgcctgcaggggacattttgttcccggcaggtaagggtggaagggcagtgtaagagactaccgccttgctggtaacagcaggggcacatgtaaaccccatccgaagcaagaccggataaagacgatgtggcggcccgtcacgtcttaggtaggtcgctggaaccttccggcaacgaaaggtctagatagatgattactcaacgacataacccggcttatcgtcttgcttgcctttagaataaaaaatgaaaataggacttaaaaacaggccatggtctggcaggatgaataacatctgccggttcatggcctgtaaagttatctgcctacttgtgaaaagatgcggcgcctaccggccatcatacttctcttcgcagtatttgcagcgatagatctcattttccttatccgtaagcacgaagatgtgatccagctcctgttcgatggaagtgatgcatctcgggttcttgcatcgtatcacattgacaatctcctttggaagatggagacgtttcttgtcaacgatctgggaatcctggataatgttgatggtgatgttatgatcaatgaatccgaggatgtccaggtcaatgaagtctatagggcattcaatcttcatgatatccttcttgcccatcttgttgctcttggcattcttgatgatcgcgacacagcagtctaatttatccagatgcaggtatttatagatgtccatgcaacggcctgcctggatatgatccaatacaaagccttcatcaatccggcctacattcaaagtgttttttaccataattgatttcctccctatacttcgattcctaatagcgttaagatcaatgccattcgtatgtatacgccatactgcatctgcttaaaatacgccgctctggggtctttgtcaacctcgacggagatctcattgaccctcggaaggggatgcagcacatacatgtcttttggcgcaagttccatcttcttggcatccaggatgtagaaatccttcatgcggacgtaatcttcctcattaaagaaacgttccttctgaacgcgggtcatatacagaagatccagtttcggaagcgcatcctccaggcggacgacctcctcgtattccacctgcttctgatccagcacgtccgagcggatgtagcctggaagccttaactcttccggggaaatgagcacgaacttgattcccggatatctgaccagggcatggatgagagagtggacggtacgcccaaacttcaagtcgccgcacaggccgatggtcatgtgatccagatgcccttttaaagatcggatggtcagaagatcggtgagagtctgggtcgggtgctgatgcccgccgtctcctgcgttgatcaccggaatcgaagagtggcggcatgccaccataggcgcgccttcctttggatggcgcatggcacagatgtccgcgtagcaggatatggtgcggatcgtatcggaaacgctctcgcccttggcggcagaactggagtcggcagaagaaaatccgaggatgcttccgcccaggttcagcatggctgcctcatggctgagccttgtcctggtgcttggctcgtagaagagcgttgccagtttcttcccttcgcacgcatgggcgtatttttcaggatttgcctcaatgtcccccgcaagatccataagtttgtctaattcttccacggaaaaatccagtggactcatcaaatgtctcatataaacctcctcttatcgatatgttaataattcatcaacagatttgcgcccgggcgcatccggatggatgtccgggtaaccgatggcgatcagcgcggcaagttcctgatcctttggaaaatcaagaagcttcgtgatgccatcctcatcccagattcccatgataacggtcccaagcccggcctcatgggcggcaaggcagaacgtctgcgccgcgatgcctgcatcgaacatctgccagcggtcaccctttttcgtggtaaatgatccatcgcgctcaaagccgcagcggccctttacgaaggtcatagcaatcagcattggtgcctgacggataatattagaattaaaatctggggtgtaattgttcatgattgaattaagaatagaagaatcttcaattgcgatataacggacgatctgactgttcttccaagaaggagaataggatgcagtagatataatggattctaatagaaaatggtctatcgggtccggcttaaacttccggatgcttcttctggttctgatacattcagtggtgttcatctcgttttcctcccatattgaaaatctttcatacatcatataataaatatgaaagattttcaacgtctgcagagaattttttcaaacaacaaccctgcgcagaaccagagaggcgcatagtcgaggcggatcagcccgttaacattcagccgggcttcgctgtaatcccaggggcaggcttcaaatttcctcaggaaagagccggtaatatattctccgataaaaatgcagcaagtatatacacctccccgtaacaccagactcttgccttttaaacgtctgcagatgggagaaaggaaactggccatgccatagatggggaacatccagatggaagtattcccggtaagtttgtgattttcgttctgcagggagtgcaggccggtgaatagaatctccatgcaccacccacaggttccgcaggttaagaaattgtgcttcatgtgtcttagtatggcaacggaaggtagattttataccaaaaatgtattataatacaacttgatttgcaaagaaggagaaaaagacatgccaacgttagaggaattgagaataaggctagacgatgttgatgaacagatggtcagactctttgaggaaagaatgagcatctgtgaagaggtcggagaatataaggtaaaaaatggaaggaaagttctggaccgccagagagagcgggacaagcttcaggaggtggccggtaaagtatccacggactttaataagaaagcggtacaggaactctatgaccagctgatgtccatgagcaggaaactgcagtatcagcagttggtcaaggcaggggccctgggcaggcttccatttatcggggtgtcctccctggatgacaagaacgcgaggatcgtattcccgggaacggagggcgcatacagccaggcggccactaagaattactttggggaggactgcaacaacttttacgtgcggaccttccgggacgccatggaagccatcgaagaaggagcggcggactttgccgtgcttcccatcgagaactctacggcgggctctgtggatgagatgtatgacctgctggtggaatttgaaaactatatcgtaggagagacaatcatcccgatcgtcaatacgcttgccggtcttccgggaacagagttgtcggatatccagcgagtttactcaaaaggcgtggctctgatgcaggcatcccgcttcctggacgagcacggcgactggcagcagatcagcgtggccaatacggcgatcgcggcaaagaaggtgctggatgagcaggataagacccaggcggccgtgtgcagcgcatatgcggccaaagtgcatggcctggcggtgctggcggacaatatcaatgatgatcagggaaactccacccgattcatcgtagccaccaaccagaagatattcctgaaagacgcgaagaagattagcatctgcttcgaactgccgcatgagagcggctcattgtaccacctgctgtctcatttcatatataatgacctgaacatgaccaggatcgaatccaggccggtagaaggtaagaactgggaataccgcttctttatagacttcgaaggaaatctggcggatccggcggtaaaaaacgcgatccgcggcctgcgggaagaaagcattaatttgaagatactgggaaattattaagaggtgaggcaaatgagaacgaatgaactgatgctgtacaaacatatggaagaaggccagatattaaatgatatgaccttcctgatggagaactacgccaacgattattataatatggaagacatgaaaggcctcctctttgacttggtcaatgagattctggaattggcggtcagccatggattcgaaggaaacctgtggcacaattacctgacctaccttcttgccagccacgagaatgcatacagcacctcctgcgagatcgtagggccggtggagggaagcatcaacgaagtggccctccatgacttcgctatctttaaggaactctttgactatggttttcaggcgctggaagagaccatgggcgtggattgcctgtcaatgatccgggactatgcaggtaccagcggacacggcaagatatttaaccagagaatccgggaccgcatctgcgacctgagcagaagccttgccaaggccgaaacgccgggaaagttcaaggatatcctgacccagttttataaagaattcggcgtgggcaaattcgggcttcacaaagccttccgaatcgagcatagggaagagggtaccgagatcgtgccgatcaccaagattgcccatgtgcatctggatgacttggtaggatacgagattgccaagaagaagttgatcgacaatacgaaagcctttgtggaaggaagaaaagccaacaactgcctgcttttcggtgacgcgggcacgggaaagtcatcctccatcaaggcgattctgaaccagtattatgaccagggccttcggatgatagaagtctataagcaccagttccaggatctgaacgatatcattgctcagattaagaaccgcaattataaatttatcatctatatggatgacctgtcctttgaagaatttgagatcgaatacaaatacttgaaagccgtgattgaaggcggactggagcgaaagccggagaacgtgctgatctacgccacctccaacaggcgccacctgatcagggagaccttcaaggacaaggcagaccgggacgaagaactgcataccaatgacacggtgcaggaaaaactctccttggtcgccagattcggcgtgaccatctatttcggaaaaccagataagaaagaattccaggagatcgtgcgaaaactggcacagaaaagcggcatagacatgccggaagaagaactccttctggaagccaacaagtgggaattaagccacggcggcctgtccggccggacagcgcagcagttcgtggattatctggccggaatgcggtaagaaggacgaatagaggaacagataaataagtataggaaaggagcgtggaacagatatccgcgctcctttcttaagtttgttgtagcagaggatgggaatagaaattgtagaatgtggtagagaaattgaaaggaattatgactggcccggcttttcatgccgggccagtcgaaacttagaaaggatattataatgcaaaggttccaataatctggccgatctgtacgatattgcttctacctgtaaattcaaacttgactttgccaagaccgctgaaatacatttccagttcgctgtccatatcaaatacgcctgcagtctctacggagaaagccgttattttagaatagggaagagaagaaaagtcttttttcttgccggtcattccttgtatattaactgcgattactcgcttgttcgtgaatacacagtagtctctcatggctttataagcaccgatgacctcctcgccattgattaacagtggctggacttctgcaaatattgatccggggtctatctctttcatttttacatattcgctgttcttaaaatcaatcattcctgttacctctctttcgcttttgtttttcataaattattttgttaaaaattttctgactggaactaggtatattatatattattttgtagaatttgcatatactaataaagtgaattatgaagaatattgttgagaaatataatttcagatgaaaacgctccatgtataaagttgtataatagattcatatatttgaaacgatagacaatgacattataaccaaacgccgcgcagttagtcctgcacggcctttatattggaaatatcggaatcaatcatcagggaatagttggtatagtataccacgaaccccggctttgccccattaggctttttcacatgttttttctctacataatcaatctctactttgtcgctgcctctgttcttggagtagtaggcagccagccgcccggcttcttcgaaggtgcgatccggcaattcatctccattacttttgacgatgacatgggagcccggcgcgcctttagcgtggaaccaccagtcatttcccgcggcaaaggagaaggtcagttcatcattctgcagattgttcttgccaacatacatatggtagccgtcactggagaggtagtgcagaggcttgctggtcagcttcacctttttcttggtgaactttcttcgcgcatacccgctctggatcagctcttccttgatctgggccagatctgcctcgctcagcgcgatgtccaaggcattgctgatggattccaggtactggatatcatcggctgtctcttggatgaggtctgagagtgcctcaaaggtacgtttctgcttattatacttggcgaaatatttctgggaattctcctggggcgtcatagtcgggtccaggggaatggtaacttcctggccggtgtaataattaagggcagtcaggttcttggagcctggagccagatcgtagccgtaagcgttgatcaattcgccgtagaccttgtatttttcccggttctgcgtatcctttaactgcttggcctgaagatcgtactttttacggttccgttccagggctgtctgtaccacatggcgtaagtccgcgcttttttggcggatgcgggtcagggtattcttagtcgcatagtaggtactgagcacctgggagatggaggaaaattccttccttgcaaggctgttgtagtgcgtcagcggcagggcgccaaactccttgggggcgctcccttcatagtagatgaccggatggaaagcgccttggcggacatcttccatatagtaggcaaactgccggaacaggtgggccatcatatcgccgcttaagtctccggcagttatgccggattccaggccggccagatagcagatctcttcggccactgcagggctgattcccgtgaaactggtatagatcgccttgccaagaggcatgggcttctccttaagagcctggccaaaggaagactcgtcaatggcaagcggattgtgctttgccatggtatccggtataaaatattcccgtccgggcaatacttcccgcacggaactcatctgcgcggagacatgcttgatgctgtcgatgatcctgccttgatcatcgcagaatatgatattgctgtgcttgcccataatctcgattaccagctgcttcttgcacagatctcccaactcatccagatgctcgatatcaaggatgatgatgcgctccagtttgggctgggagatgccggtaatccgtccatttccgacatactttcgaagaagcatgcagaagttgggggccgtcattgggcttggcttgttctcgtctgtcagatatatcaaagggagggatgcgctggccgagatatagagtcttttttgtcccttcggagtcttgatggtgagcagcagctcgtctggctccggctgggcaatcttggcgatacgtccgtctgccagcgcattttttagttcctggaccattgcagcaactgtgattccgtcaaatgccatagatatgtccgtcctttcttactgaaataagaagattataacatagttgacgggatatgccaaatgacttataattatcagtggcaattaagagacatatagcaaatatattataagaagaggttcatatcatgataaaaagtatgacagggttcggacgctgcgaagtgatggaaggggagcgcaagttcacggttgagatgaagggggtaaatcaccgctacctggatgtaaatatccgtatgccaaagaaactgaattttttcgagacagcaatccgcagtttgttaaagcagagcatccagaggggaaaggtagatatcttcatctcctatgaggactttaccgagaaccagatgtccctgaagtataatgagtctctggcgcaggaatacatggactgcttcggccggatgaaggagcagttctccttggaaaatgacatccgggtatctacgctgtcccgctgtccggaagtgctgactatggaagagcaggtcattgacgaggaagaactctggaatggccttaaaaaggcgctggaaggcgcgatcggccagtttgtggagaccaggacgctggaaggaagcaacctcaagaaggacattatagaaaagttagacgggcttctggatctggtgggctacattgaggaacgtacgccgaagatcgtggcagaatacagagagaagctggaagccaaggttcgggaactgctggaggatacacagatcgaggagagccggattgccgccgaggtggtcatatttgcagataagatctgcacggatgaagaagtggtaaggctgcgcagccatatcatacatatgaaggagaccctgcagtctgaagaggccgggattggccgcaagcttgacttcatcgcccaggagatgaaccgggaggccaatacgatcctttccaaggccaacgacctggaagtatcaaacgttgggatcgacttgaagacggagattgagaaagtaagagagcagattcagaatatcgagtagtgggagagaggaaaagaccatgactaaaaaaggaattcttattgtcgtatccggtttctcgggagccggcaaaggcacgatcatgaaagaactgctgaagcagtatgacaattatgcgctgtccatctctgcaaccaccagaaagccccgcccgggagaggaagagggcagggaatatttcttcaaaacggtgaaagaatttgaaaaaatgattgcgaaagatgaactgatagagtatgctagatacgtggacaattactatgggactccgcgcgcctatgtggaggagcagttggaaactggcaaggacgtgatcctggagatagagatccagggtgccctcaaggttaaggagaagtttccggagacgctgcttctgttcgtgactccgccgacggcgaaggaactgaagcaccgcctggtaggccgtggcacagagacgatggatgtgattgagttccgcatgaaccgtgccaaggaagaggccgagggcatggataagtatgattacctgattgtcaatgatgtacttgcagaatgcgtagaagaagtgcatcagatcattcagggagagcacagaagaagttttcgtaatcaggcatttatagagcatatgaaggaagaactgaaaggagaataacaagcatgttacacccatcttacacagatttaatgaaggtcgttaacaaagacgtagaagagggcgctaccaaggtagtaaacagccgctactctattgtgatggctaccgccaagagggcgagggaactgatagacggcgctatgccgctggttgcggcaaagagtggcgagaagccgttgtccatcgcaatcaatgaattgaaccaggcgaagatcaaagtagtcggcgaggaagaggattaatacgtaatacgtatgtgagaatacaaggcagatgccggggcggtatctgcctttcttctaaatacctttactttatagagagcatggtttttcaaaaggaggaacgaatgaatatattgtttatatcccttggctgtgacaagaatctggtggattcagaagttatgctgggacttctggctgccaaaggataccggatggtggatgatgagatgcaggcggatatcattatcgtcaatacctgctgtttcatccatgacgccaaggaagagagcatccagacgattctggagatggcacagtacaagacggatggaaggcttaaggtgctggttgtgaccggctgccttgcgcagagataccagcaggagattctggatgagattccggaagtggatgcggtgctgggaaccacatcctatgacaagattgtagaagcggtggaggaagcgctggctggcaaaggccacgtggaagtggaagacatcgacgcgctgccgctggtggatacgaggcgcctggtgacgacgggcgggcattttgcctatctgaagattgcagaaggatgcgataagcattgtacttactgcattattcccaaaatccggggggatttccgaagcgttccgatggagcgccttgtaaaagaagccggggagctggctgagcagggcgttaaggaactgattctggtggctcaggagaccactttatatggaaaggatctctatggagaaaagtccctgcacaggcttcttcgggaactgtgcaggatcagcggtatccgatggatacggcttctctactgctatccggaagagattgatgagaacctgatccagatcatgaaggaagagaagaagatctgccattatctggatctgccaatccagcatgccaatgatgatatattgaagcggatgggaagaaggacgtccaagaatcagttggaagagatcatcggaaggctcagaagagagattccggacattgccctgcgtaccacgctgatcaccggatttccgggagagacgaaggaacagcatgaagaactgatggaattcgtagatgagatggaattcgaccgtctgggcgtatttacctattctccggaagaggatacgcctgcggcaggcatgccggatcagatgccggaagaagtgaaggaagagcgtcaggcggagattatggaactgcagcaggagattgtatttgaccaggcagaggctatgatcggccgggaagtgctggtcatgatcgaagggaaagtggccgatgaaaatgcctatgtcggaaggacttataaggatgcacccaatgtggacggcctcattttcataaatacagaggcagaactgatgtcgggagattttgccagagtgaaggtgaccggcgccttagaatacgatttgataggagagttgatggaatgaatttaccaaataagttgacagtattaagagtgattatggtaccgtttttcgtgtttttcatgctgacggatgtaggaggagcagtcaataagtggattgccctggtgatattctgcgtggccagccttacggacatgctggacgggaagattgcccgcgctaggaatctggtgaccaatttcggaaagttcatggatccgctggcagacaaactgctggtatgctctgccatgatctgcctgattccatccgggaaactggctgcgtggatcgtgatcgtgattattgccagagagtttattatcagcggattccgcctggtggcatctgacgctggaatcgtgatcgccgcaagttattggggcaagttcaagacggtttcccagatgttcatgatcatcgtgctgattgcggatctgggcggtgtatttgacatgattggaacgatactgatctgggtatccttaatactgacgatcgtatctttgtttgactatattgcaaagaacgtacaagtattgacacagggaggcatgtaagagatgactgtagaaatgatatccgttggcacagagatattattaggaaatatcgtgaataccaacgctgcatatctggcggaaaaatgcgcgctgcttggattatcctgctattaccagagcgtggtaggagacaatgaggagcggctggaggatgcaatccggctggggctgtcaaggtccgatatcctgatcttaagcggcggccttggacctaccaaggatgatctgacaaaagaggtgacggccaaggtatttggcagggaactctatgaggatgcccataccaaggagcgcatccagcaatattttcggcaggtccacagcagccaggtgacgccgaacaactggaagcaggcattggtaccggaaggcgcaaaggtagtggataaccataacggaacggccccgggactgattctggaggaaaatggaaagatcgccattctccttcccggaccgccgaatgagattaagcctatgttcgagcaggatattgcgccgtatctgaataaactgcagccggaaggcatctattcgaagatggcaaagatctgctccatcggggaaagcaaggcagagaccatgatctctgacctgatggatgcccagacgaatccgacgatcgcgccttatgccaagacaggagaggtgcatcttcgggtgacggccaaagcagacagcgaggaaaaagcgcaggaactgatggcgcctatgatggaggaactcttccagcgctttggcgataagatctatacgacggaggaagatgtgactctggaggaagccattgtacggatgttagaagcagatggcatgacggtgacgacggcggagtcttgcaccggcggacttctggccggcaggatcacgaatgtgccgggggcctccaatgtctataaggaaggctatatcacttattccaatgatgccaaggaacgtctgcttcatgtgaagagggagacgctgatgcagcatggggcggtaagccctcagacggcatacgagatggcagaaggcgtggcgttcgccgctggggcggatgcttccttaagcataacgggaattgcgggaccaggcggaggaaccgaggaaaagccggtcggccttgtctatatcggctgctatgtaaaaggccatgtaagggtagaggaattctattttacaggcaatagggacaagaaccgggaatatgcggtggcaagggcattgacgctgctccgggaggagttgcttgaaaggaggtagaagatggacgtaagaatattaaagcagcatgagattcttccggctctccatctgatatgggaagtcttcgcagaagatgtggcgcctgcgtatacgccggaaggcgtagcccattttcaggaatttattaagtatgacaatatcagcgacatgtaccagaagggagagattaccttcttcggagcctttgaaggaacgaaattatgtggcaccatggcggtgaagtccgtgggccacatctgtctgttctatgtcagaaaggattgccagggaaaaggcataggacggatgctgttccaggctgtctataactactgcgcgcagaaactgggggtcagtaagattactgtgaatgccgctccgggagcggttcccaagtatgcccacatgggcatgcaggcgataggggaagagcagcaggtaaatggcatacgctatgttcctatggagatgcaggtgataccgggacttatgcagccagtgaaagaaaagtcaaaggcccctgtgatcatcgtgaccgcggtgtgcatcgcaatggtactggttctgatcatcgcaggagtggccattggcagaaaggtaagacatatgctccgggagcaggacttatatacgcagccatatgaccataaggacagggaccatgattatgacgaccaccatgactatgattacttcggggatgacggtgccggacagaacagcacggatgccggagaattgaccggaattgacgcaatcccccagaaaatcgcggacggactatcctatgaccttgaggaagatgcatatacatatcaggatgataagaaacagactacgatgattgactttaacgttaattatccggtcatcagcgggcttaaggatgccaaagcagaagaaaaggttaacgaggcgttgaagaactgcgcgttacagacggtagataagatctatgacaatccctcggacgagatgaaggagcgggtgctctcttcttcccagccagcgctggtaagttatgttaagtataaggtgacctatgcgtctgaagacctgttaagcgtggccttcgaagattacagctatcagggaggggccgaatattccaaccaggatttgcggacctgcaatatcagcctcaaggacggaagggtctatgaggtcaaggacatcatcaggctggatgatgcctttctggctgagtgggctgatattatgagggacgaggcggacaatgacgcttttctgtctgaactggataaagatgccatgaaaaagacgctggaaggagattccctggatggcgtgtatgaggtgaatttcttcctggatgcagatggaatcgagattggctacaacctgaattacaaagaaggagacgccaacaatctgggctatatctgggtgacggcgccgtttgattatgatgagatcgcagaattcaggacggacagcgatttctggacggggttataatatggaaatacgtaatattgaaagtacggatatagccagggcgcttcaaatggccgggaatgtccggatggaatattcgcaggaacagctgctgcagatggccgcaaaaggccaggtgacgattgccggctgctatgcgggcagcgaattactggggtgggccatggcagatgacagaggccggattcttatggtctatgtggcagaggcgcatagagggcataagatgggaacggcgctgatagacatgctgtgccaggcctgtagccagagatattctgttcttcgaataacggtggaggccgcccccgggatgacaggcttctttaagcactgcggatttacagcgtatgcagaagagcagacacagggagaggctgtttatatcccaatggagcgtatgatatcgccgtcccaggtaaagccgcagggaaagaagaataggctggctttgggccttatcattggggcggtcgttgctgcgatcgtcctgctggccgtctgcggcgtttttctcggcaggaaagtagcagccgaaatccaggccgacaaggccaagaagacgacggagagttccctcccctcggaagatgctggctccaggccagacgatgacgcccaagacgaagaagactatgggaacgatggctcggatgacgggcaaaaagaagccaccgtcgatgacgtggagttagaagatatcgaggcttatgtggcagagaatcttccttacgaagttgcagaagagacttatgaggaagagaaaaaagaaggaaagagcaatataaacttccatatcagctatcctcaagtacatggactttcaagcggcaaggacgcggaggtgaaccagatacttaaggacgcggctatggctaacgcgaaccgcttttatcttgttcccgacgaggatatcaaggcatatgccaaagagcagcaggaggcctatcttgcaagcgaggtcaagtataagattacctatatggatgcaggccttttgagcgtggcttatgacgaccattattttgcgggaaattatgcggcagaatattcagccctgcgtacccgggtgatcaacctcgacactgcagaagagtaccaggtggaggatgtggtggatggcaatgacgccttcgtcaagtcgctgcgggaaaagatgcttgcccaagttccggatagttatccggccaaggaactgtcagacgcatatttcaaacgcatgatggaaggcgagattgtggataaccggtatctgaccaacttcctgctggaaaaagacggtcttgcaatcggattcacttttgcattccgaagcgaggatggcgacaggctttcccgggggtggattctttctgaatattccggggctgaaattcgaccatatatgacggggaatgaactgtggaatttgatagaaagtgacaattgacgaatattgaataatatgagaaaataaagtaagtatggtgttaaagatataacgaaccttacgacagaaaatcatgcaaatttgaaaggagttttaaaatgatttattcacatgaagtagaaatgatgtgtcctgtagctcagggtgcaaatcacgggccagctccgattccggaagaggcaaagtgggtacaggctaaggaagttaaagatatttcaggttttacgcatggtgtcggctggtgtgctccgcagcagggtgcctgtaaactttcattaaatgttaaagacggtattatccaggaagcgttggtagagactatcggatgctcaggaatgacgcactctgcagccatggcatcagagattcttcctggcaagacgattttagaagcattgaatacagaccttgtctgcgatgccatcaatacagcaatgagagaattattccttcagatcgtatacggaaggacacagagcgcgttctccgaagacggacttgcgatcggagcaggcttagaagaccttggaaagggacttcgctcccaggtaggaaccatgtatggcacattggcaaaaggtcctcgttatcttgaaatggcagagggatatgtaacaggaatcgcattggatgagaatgatgagattatcggttaccagttcgtaagccttggaaaattcactgacttcatcaaagcaggcgatactccgaacgatgcttgggagaaagcaaagggacagtatggacgtgttgcagacgcagtgaaaatcattgacccgagaaaagagtagaaaatcaggaggacaagtaaatggctttatttgaatcatatgaaagaagaattgataaaatcaatgaagtattaaatagttatggcattgcttctatcgaagaggctcagcagattacgaaggatgccggacttgacgtatacaaccaggtaaaagggattcagccgatctgcttcgagaatgcctgctgggcatacatcgtaggcgcggctatcgcgatcaagaaggactgcaggaacgctgcagacgcagcagcagcaatcggagaaggacttcaggctttctgtattccgggttccgtagctgaccagcgtaaagtaggccttgggcacggcaacttaggcaagatgcttctggaagaagacacagactgcttcgcattcctggccggacatgagtctttcgcggctgcagagggcgctatcggtattgcggagaaggccaacaaggttcgtaagaaaccgctgagagttatcctgaacggacttggaaaagacgcagcgaagattatctccagaatcaacggatttacatatgtgcagaccgaatatgactatcatacgggagaactgaaggaagtaaagagaattgcttattctgacggactccgctctaaggtaaactgctatggggccaatgacgtgcgcgaaggcgttgccatcatgcacaaggaaggcgtagacgtatccatcacaggaaactctaccaacccgacacgtttccagcacccggttgcaggcacctacaagaaagaatgcatcgagcagggcaagaagtacttttccgtagcgtccggcggcggtacaggacgtacccttcacccggacaacatggctgcaggaccggcttcctatggtatgacagatacattgggacgtatgcactctgacgctcagtttgcaggatcctcttccgtaccggctcacgttgagatgatgggcctgatcggagcaggaaacaacccgatggttggtatgacggttgcagttgcggtttctgtagaggaagcggctaaggctggcaagttctaagaaaaacttattttataatgattccaggaattgtgagttgtgctgataagttttgaaaatgaatatgtatagatcaaaagcggaaagcagaatgctttccgcttttgcagttttgccatttttatggtatcctatatcaggatgcaaatttgtggagcagcatccaaataagaaaaaggatgaagagaaaatgggcgcgttatacatgataagcagggcgatatcaatagggattattattggcttcctgggaggaggcgtaaaaatggccgtgaagaagaattattccgagcgggagattttaaagagacgcaaattcgtagacaaggctgcatttgtgctgaagtatatgacctttcttctgctgtgcctggggcttgtctggtgcgtgtatttcctgattctgggagccatagcgccgggaaaggcagaatatgccaacaatatgtctgaattgatcgttgccgtgcttaccgtgatttccattgtctttgcttttgtcgagttcttaaggcgtacggacgataaagacgataaagacggcaagaaggattgatacatattagggggagacaagacagaaaaggggagtaaaaatatgaagaacgttaagaaaatcgtagcattcgtgattgcagccgcgctggttgccacgggatatgcaagcttggacgatgtggctggcatgctgggcgagccggaggcgaagatcgctgatacgatcgccgagggcgagatgaaagtcacattcctggatgtaggacagggagactgcacgctgatccaggcaggcggacagaacatggtgatggatgtaggcaataatgaccagggagagcgagtggtctcctatcttaaggagcaagggatcgggaaactggattaccttcttctcagccatccggacgcagaccacatcggcggaggggataatgttctggagaactttgaagtacagacggtgatcatgccggaggtagccaatgataccatgacctaccaggaggtaatggaagagatcagccgatacgatgtggacgtaaagtacccggaggtaggagatatctttacgctgggagatgcggaattcaccatcctgtgtcccaagccggaacttttaagccaggatgacctgaacaattcatccgttggcatcaagctggtccatggagagaattccttcgttatgtgcggggacgccgaagcgaagtcggagcaggaaatggtaaagcgctttggaagcagtctggaatgcgatgtgttaaagtgcggccatcatggaagcagcacggctacaagcgatgaatttcttgcggctgtcaatcccacgtgggcagtcatcagctgcggaaaagagaatcggtatggccatccgcattcagaggttctggacaaattagaaaatgatgatgtccagatctaccggacggatctaagaggtaccatcacggcagtaagcgatggaacccagatctcgtggaaatgtgagaaatagtgggaatattcgaaaaattatgctggtgctttagcacggaacagtgtataataggagtgttaaatacaaaatccataaacttacggatatgagatttatgaagcagaaggagagaagagtatgaagaagaagttattggcagcatttttatgtctcgcgatggcattctcacttgcggcgtgcggagacagcgatgatgcgggaaagactgacaaaaagaaggacagcaaagatgacggcaagaaagtgtaccaggttgccacggacacgacatttgccccatttgaatttgagaatgatgaaggcgatatggtaggcatcgatctggatatcctggctgcaatcgcagaagaccagggatttgaatacgaactgcagatcgtcggattccaggcggcagtcaacgctcttgaggcaggacaggccgatgcggtgatcgctggcatgtctattacagatgaaagaaaagcgaagtatgatttctcagatgaatactatcagtccggcgtaggaatggcagtaaagaaagattctgacattgattcttatgaagacttaaagggcaagacagtagcggccaaactcggtacggaaggctgtacatttgcggagtctatcgcggaccagtatggatttacggtgacacagtttgaagattcttctaccatgtaccaggatgttatatccggaaatacggttgcatgttttgaagattatccggttatgggatatgagatttcccgcggactggaactgaagcttcctttagatatggaaaaaggcgcgccttatggcttcgccgttatgaagggcgagaacgcggaacttcttaagatgttcaatgctggacttgcaaacctgaaggaaagcggcaaatatgatgaaatattagatacatacattaagaagtagataggagtcttaccatggatatcattcgagtactacaggaatattggccatctttttgcaaagcgctgatgatcacgctggagatgacggtgttttccctgatctttgcgacgatcatcggaaccatcgtgggattattcaatgtctccaagatcaagccgctgcaattcattgccaatatttacatagacattgtcagaggaacccctctgctggtccaggtatttatcatgtactatggactgacgcagtttctgcagttccagtggccggcaatcggaggatttacatcagccttcgtcgcaggcgtggtaacgctcagttttaatgccggagcctatatggcggagatcatccgcggcggtattgaggcagtggataaggggcagatggaagcagcaaggagtctgggccttccttataagaaggcaatgtggaagattatccttccacaggcattccgcaccatgcttccgtccatcatcaaccagtttatcatttccttgaaggatacttctttgatatctgtaatcggaccaagagaactgacccagaacggcaagatcattgctgcaaattcatccacaagggttatggcaatctggattgttgtagcgttattctatctggtggtatgcacgatcctttccagagtagcaaaactggtagagaggaaggtgtcatatggaaagtaagattagcgtaaaaggactgaagaagaattttggcaagcttcaggtattgaaaggaatggatgtggaggtaagagaaggcgaggtcgtatgcctcatcggcccttccggctcaggaaagagcacatttctcagatgcctgaacaggctggaggatatcacggacggaaccgttgtagtggacggctaccagatatcagataaaagcattgatatcaataaggtgagagagaatatcggcatggtattccagcattttaatctcttcccgcatctgtccgtattggagaacatcaccatggctccggtagaattaaagaagatgccaaaggatgaagccgataagaaggcaaaggaacttctcaagaccgtagggcttgaagaaaaggcagatgtctatccggcgcagctttccggcggacagaagcagcgtgtggcgattgcccgggcgctggccatgaatccggacatcatgctttttgatgagccgacttccgcgcttgacccagagatggtaggagaagtgctggaagtcatgaagcgcctggccgcagagggcatgaccatggtcgtggttactcacgagatgggatttgccaaggaagtggcacatagggtgatcttcatggatgatggcgtgatcgtggaagaagggaagccaaaagaagtttttggcaatccgcagaatccaagaaccattgatttcctgaataaagtattgatctagcacgcctgcacggcaaagcgcataagggctggagatggaagcataatctgcttgcatttccggctcttttttgtatcataggaaacttcgttccatttccttataaattctttagaaatgccttttatactgtcctcataaggaggaatcagatatgaatcataccatactagaaacccagacattgaccaaaacattccgcagccaggaggcggtaaagaatatttccctgtgcgtccctgaaaactgcgtatatggcctgcttggccccaacggggcaggcaagtctacgcttcttaagatgatcacaggcatcttaaggcccacatcggggcagatacgcttccagggccacccatggtccagaaaggatctggcagacatcggggcgctcgttgagacgccgcctgtatacgagaacctgacggcatgggaaaatctgaaggtacgcgccatcatcctgggcgtgcaagatgaaaggatcgaagaagtgctggaacaggtggacttaaaatttaccggcaaaaagaaggcgggagaattctctttgggaatgaagcagagacttggaattgccattgccttgctcaaccgacccaaactgctggttctggatgaaccggtgaatgggctggatcccatcggcatccaggatctgcgccagatgatacgaagatttccggaacaggggattaccgttattgtttccagccatatcctaagcgagatcgagcagacggcagactatatcgggattattgccggcgggacgctgggatatcaagggggaatgccaaagaagaaccatctggaagaactatttatgaagattgcgatggaacaggcggggagggagagagatgcatagattttatcaggcggaaaaactaaagaatcgtcattcagccatcggcagattaacaattctaatgccgcttatcagcgtgatcctgtcagccgtactgaccagcagattcttcaccattgacagttacaactggtggtatatgatgctgtttccagggctcgtaagcctgatatgcggacttgcgggacagcgggataagaagatggggaaccgttccatccttacgctgccggaagatccaaagcatgtctgggacggcaaggtgctatatgtcatacgagaagccactgtggctctgatcgtcatatttgccgcgtccgtcgtaattgccgcaatccttcaaagaggcatgcaaatgtcttttgcagtgtatccgtccctgggaagccaggtggcggcgacggcgctgctgctggtaacgtttgtctggcaggtgccattctgcctgatgcttcagcagattatggggatcttcccgatgctgcttctaaatatgggcacatacttcgtcatagccgccacggcttccttgaagtcctatttcttcctgatcccgcaggccattgcctccaggctgatgtgcagcgtgatcggggtgcttcccaacgggcttccggcaagacctggtgagatgacattctcgccggaactgctggatacaggcgccctgtttccaggaattgccgcctccatgctatggcttgccatcttctggatagccggaaggaaactatatgaaaggacggtgagaggctaaatgagagaagtatttcgtacgctaagggcggaatcctggaagatgaagcacaccttgctgccgcttcttcatctgctgattcccgcggcaggagcggccatcttcctgggctactatcgtttcgccgcgtttggcgatatggggcaggtcagcggctatatacaggtgctggccatcgcgctgcctgtggtggcaagcgtgctgtgctccatgtcggtggaattggaggcgcagaatcattttcaaacgttcctgagcacgacgacccgcaagcacagcccgctgctggggaaatggatcgtccttgccttgtggggatttggtgccatctgcctggcggtggagggatttgcgctgggataccggtacctgctgggaaaggcatccgtcagccagaaggcgtatatggccatcattgtggctatgacggtaagcctggcaaacctgtatctgatccatctatttttgaacttgaaggcatccaaaggcatctctatgtgcataggaatcagcgagtccctggtggcggcattgttccttacgggtctgggggaaggaatctggcagtatgtcccatgcgcttacactggaagatgggcttcatatctgctattatatgattcagggagaaaagagatggcagccgcaggccttacgggagaaactatgctggtctgcctgctggcatcggcaggcatctggatcctggtattcctgtggttcggactatatgaaggaaggcaatgcaatgactaggatattggcgattgacgatgaaaaagatatactgatgctgatcaagaatgcgctggcaaaggagggctatgacgtgacgcttctaagcgatcctctgaagatcggggaattgaatctgaatgcgtaccagctgatcctgctggatgtgatgatgccggggcaggatgggttttccctgtgccgggacatccgggaccaggtagactgccccatcctgtttttgacggccaaggttcaggaggcggatattatggaaggccttggcatcggcggggatgactacattaccaagccctttggaatcggagaactgcgggcaagggttgcagcccatctaagaagagagggaagacagaagaagaatgcggtctcggtgggagacgtgcagttcctgcttcaggcaaagcaagcggtgtatgaaggaaaggcgctggaactgaccaaaagcgagtatgcgatctgcgagtacctggcattgaatcacggacaggtgttttccaaagacagaatctatgagcatgtctttggatatgacggggaaggcgacagttccgcgattacagaacatatcaagaacataaggggcaagtgccagaaggcgggatttgcgccgatagagaccgtatgggggattggataccgatggaagtaaaaagaaagccaaagacgatagcagccatattcattcgatatatcagcctgttctgcgtcaatacgcttttgatcctgggcatccttttccttgccttcagtgtgctgatcaatataggaagcatccgcagggcagatgatatgcagacccggctgaacgaaaacgtttccgccatcaaaaaagccgacaaggttacaaaagagattcttccggaagggtgcggctacggcgtttacgacaaagacggcacctatctttatgggacttatggggagatagaagccagggaagcgtggaagaactataaggaagataatatctatgcaaggggcaagggatactaccgtttcattgccaaggaagatggggaactctgtatcgttaactatttcattgaggccagatatacgaacgcggcatggaaccgttacctgccaagcccagcgatcatgatagtgattctctttgtcctgctgttccttgttcagacagttatactggcgagcagttttgggaaacatctgtcacggaggcttgaggccatgaatgagatgacgcagaagattcagcggagagatctggaattcgacgaggaacattccgatatcaaggagatcgatcaggtgatggattccctatacaggatgaaatgcgcgttaaaggaatccctggaagagcagtggaatcaggagaaggagacgcaggagcagatcgcggctctggcgcatgatatcaagacgccccttacgatcatcaagggaaacgcgcagcttctggaggaaggaagccttgcagaagaggagcaggagtataatcagtatattctaaggaatgtagcggaaatcgagcattatcttgccctgcttcgagaaatgctggtgtctccaaaagaatctgtcggagaagagaaaatcagctgtcaggaactgggagagcggctggaagagcaggcaaggattcttgcggctgcctccaggcaggaagtcctttccataaagggggaactggcaggagaggccaggtgcgattacagccagattgaacgggcatggaacaatctgatcggcaatgcattggagtataatcccgaaggcaaagagttacggatagacttccagattgccctggaagaagggcaggcgtatcttgctgcaaaggtgacggactggggcaggggatttgatgccagagacttggcccatgccacagagcagttctatcaaggcgatgaaagccgccatgacaggagccaccgcggcatcgggctttatacggcggccaggtttgccaaggcccagggaggaaggctcctgctttccaactccgaagcgacaggcggcggggaagtaacgctgtatcttagattagaatagaaaaaggccatcagatatatacggcatatgtctgatggcctttgtttgtactactaaggagccaaattatgaattctggcttgcttccatattcttattggcagtggacagcatcagcttgatcctgttcagctggtttacttcgcttgcccctggatcgaagtcgatggccaccacgttggagttcggatgtcgtctccggagttctttgattacgccttttcctaccacatggttgggcaggcaggcaaacggctgggtgcatacgatgttcgcggcgccgctgtggatcagttccagcatctctccggttaagaaccagccctctccggtctggttgccaagagatacgatctcggaagccatcttgccaagttcgtcaatctttgccggtggatcaaaatgccggctcttcttaaacgcttctgtggcaggcgcccggaaccattctaacgccttgatgccaagatttcccatggtcgccttggacttcttcatgcccaggtgggacactttgaagttctggttgtagaagcagtagagcaggaagtccagaagatcaggcaccacggcctcggccccctcgctctccagcagatccaccagatgattattggcggcgggaaggaacttcaccagaatctcgcctaccacgcctacccgcggcttcttcacatccagcagttccaggttattgtcgaagtcctcgataatctcccggcataattgcttgaacctcctcctggaaggatagccttgggagaggaactccttgcagacgcccttccacttttcgtgcatagcattggcagaaccaggcactgcctcgtaaggccgcatccggtagacgcatttcatgaagatgtctccgaagatcgccgcatagattccacgcagggccagggaaggggtaatcttgaatcccgggtttccttccaggccgcttaggttgatggagatcaccggaatgtgcccgaatccggcctttttaagcgcccggcggataaagccgatatagttggaagcacggcatccgccacccgtctggctgataatgacggcaagcttatcggtgttatatttgccggacaggatggcctccatgatctggccgactaccatcagagatgggtagcaggcatcattattcacatatttaagccccatatctaccgcctgcttattgtcgtttggaaggacttccacatgatagccggatgcctggaaggcaacctccagcagatcgaagtggatgggcgacatctgtgggcacaggatggtatagtctttgcgcatctccttggtaaacggaaccttggtgatggcggcagactgtatcttgcgcttatcgtttctctgttctcttacccggatagcggcgagaagagagcggacacggattctggccgcgcccagattatttacctcgtcgattttcagcgatgtatagatcttatccgattcattcaggatggaagccacctggtcggttgttacggcatccaggccgcatccgaaggaattcagctggatcagatccagattatcggtcgtcttcacatagttcgcggcagcgtacaggcgggaatggtacatccactggtccatgacgttgagcggccgctccaccggattcaagtgggagacggaatcttctgtaagcactgcgatgtcataagagttgatcaattccggaatcccgtggtttacctccgggtcaatatgataagggcgtccggccaggacgatgccccggttgccggtctcattcagatactgaatggtttcctcgcccttgctgcgcatatcctggcggcaggctgccagttcttcccatgccgcatgcacggcagacttgatctctccttcgaaaatcgagaacttggaggataattcttccaccagccggtaggcgatagtctcttcatttaagagcgagaggaacggatggatgaaatctacgtccccatttacaatggcgtcaatgttattcttgatattctccgggtaggaggtaacgatcgggcagttataatggttgttggcatcctcgaactcgttgcgctcataaggaacgctggggtagaagatgtgccggatgccctgatcgatcagccactgcacatggccgtgagccagcttggcagggtagcactcggactcgctggggatggattcgattcccaactcatataccttcttggtagaagaaggagaaagaaccacgcgaaagcccagagtcgtaaagaaggtaaaccagaacgggtagttctcatacatattcaggacccgtgggattccaatcgcgccgcgttttgcctcctcttcgccgagaggctggtaatcaaagtagcgtttcagcttatattcaaacaggttgggaagcttgttctgtgccttctccttgccaagcccccgctcgcagcggttgcccgtgatgaacttgcgcccgccgctgaaatggttaatggtcagacggcagttgttggtgcagcccctgcacttggtcatagtggtggagtactctagggcctcaatgtcctcgatggacagcatggtcgtgccttcgcagtctatgtaccgttccctggctatgagagcggccccaaaagcgcccatgatgcccgcaatatccggacggatggcgtggcagcctgcaatcttttcgaaacttcgcagcacggcattgttatagaaggtgccgccctgtacgacaatgtgatttccaagttcgctggcgtcggataccttgatcaccttgaatagcgcgttcttgatgaccgagtaggcaagtccggcggaaatatcggatacttccgcaccttctttctgtgcctgctttaccttggaattcataaaaacggtacagcgggtgccaaggtcgatcggattcttggcgaataacgcctcatgggcaaagtcctccaccgtgtagttgagggatttggcaaaggtctctataaatgagccgcagccggaagagcatgcctcgtttagcagcacattgtctaccgtctggttcttaatcttgatacatttcatatcctgaccgccaatgtccaggatgcagtctacatccggctcgaaaaaggaggcggcatagtaatgggataccgtctctacctccccttcatccagcaggagggcggccttgatcagggcctcgccgtatccggtagagcaggagtggacgatctcgacgccctcgggcagcttgctgtaaatatctttgatcgcgtggatcgtcgtgcccagcgggtctccctcgttattgtggtagaaggaatacagcaaggtgccgtcctcgcctaccagggcggccttggtggtggtggagccggcatcaatcccaaggaaggccttgcctgtataggtgtccagatccttaaccggaacctgatgcttcgcatggcgctcggcaaattccttatagtctgcctcgctggagaataagggctccatgcggtctacctcgaactccatcttgatcttgccttccagccggttctgcatctcctggagagagacatccagatcctttttcgagttcatagcagatccgatcgccgcaaacagatgcgagttgacaggcacgatggcgtgctcgtcatccaacttaagcgtacgtacgaaggactccttaagttcagacaggaaatgaagcggccctccaagaaacgctacgtgtccccggattggcttgccgcaggcaagtccgctgatcgtctgattaacgacagcctggaagatggaagcggccagatcctccttggaagccccttcattgatcagaggctgtatgtctgatttggcaaatactccgcatcttgcggcaatcgagtacaatgccttgtagttcttggcatattcgttaaggccggaggcgtccgtctgaagaagggaggccatctggtcgataaaagagcccgtaccgccggcacatacgccgttcatacgctgttccacatttccgccttcaaaataaatgatcttggcatcctcgccgcccagctcgatggccacgtcggtctgaggcgcatagtgctgcagggccgtagatactgcgatcacttcctgtacgaaaggaacgccaagatgcttggccagcgtaagtccgccggagccggtaatcacaggagaagcgtggactgcgcctagcttgaagatggctcttccaagcagatcggaaagagtctcctgaatattcgcaaaatgcctttcataatcggaaaaggcgatatcgttattctcatccaccaaggcgatttttaccgtagtggagccgatatcaattcctaatgtatataattctttctggctcataatatgtaactccttattacaaatgtatatcccaccattgtccgtacatgcccgtatttttaaaactgcggcctcgggaagaggaagggtatcttcttattaatatgtgttttcttggtttacaacttgtaacattatacgacaaaatatttgaaatgacaattcgcaaatgtgatagaaatataaaaaacctgttaaacttccatggtagaattgacaaacaaacctcaaaacggtagaatgactacagtgtgaaacgaagaaagcagggagtagaatttatgaataattggctgaataaactggaaaaaaagattggaagattcgcgattccgaatctcatcaactatattgtcatactgtatgctttgggatatgtaattgtcatgctgaacccaatgatatattttcaatacctttgccttgatcctgttgcgatcatgcatggacagatatggaggattataacatttttagcgtttcctccgtcaaccaatatattcctgtgcgcattgctgctgtatgtagattatctgatcggccggcagctggaggcagtgcttggaacgttccgattcaatgtattcgtgatccagggcatcctgcttcacgcgattgcggcagtcgtagtatatgtattgaccggcatgccggtggttatggattcacagtatattattatgtccatgttctttttattcgcggcattatttccggaagcacagtttatgctgtattttgccatcccgatcaaagggaaatggattgcctggattgacgccatctactttggctatgcgattgtcagctacttcctgccgttcggaaacggagggagcgcgaacgcggcgctggcggccgcagtatccgtgataaatgtcctgctcttctttatgagcgcaaggaatacgaatccttattctcctaaagagatgaagcggaaaagagaatacaagaagaaggtagagcgggcgcagcgtcccacgcacgtatatgagaatggggcaaaacacaaatgcgctgtctgtggaaggacagaactggatgatccgagcctggagttccgttactgctcgaaatgtaacggcaactatgagtattgccaggatcatctgttcacacatacacatgtaaaatagaaatgagagagggaagcaaaagaatatgaagaaaacgaagattatatgtaccatgggaccaaatactaacgatgcaggactgatgcgggcgctggttcagaatggaatggatatcgcaagatttaatttttctcacggagatcacgaggagcagaaagcccggatggatatgctaaagaagatccgggaggaagaaaacaagccggtggcgatccttctggataccaaggggccggagatccgtacagggatattaaaagatgggaagaagatcaatctgcaggccggcaacctctttacattaacgacagaggatattgtaggcgacgagagcaaagtgtctattacttacgcaggcctggttgaggacgtgcaggttggaagcacgatcctggtggatgatggcctgattggcctgaaagtaaaggaaaagaaaggcaaggagatcgtctgtaccgtaatcaatggaggagaacttggggagcgcaaaggcgtcaatgtgccaaatgtgccggtgcgcctgcctgccattaccgataaggacagagaggatattcgctttggcgtagaacaggagatcgactttatcgcggcatcctttgtccgcaatgcagagtgcatcctggagatcaaggcatttcttcgggagtgcggcgcgccatatattccgatcatcgctaagatcgagaatgcggaaggaattaagaacatcgatgagatcatccgctgcgcggacggaatcatggttgcccgtggagacctgggcgtagagattccggcggaggaagtgccctatctgcagaagatgatgatccagaaatgtaatgataattataagccggtcatcacggcaacccagatgctggattccatgatccgtaatccacgccctaccagggcggaggttaccgacgttgccaacgccgtatacgacggtacggacgcggtgatgctgtccggcgagacggcccagggaaaatatccagtggaagcgctccagatgatggtgcatatcgtagagaataccgaggaacatctggactatgaaacgctgctcaaaaaagcggaagaacaccggatgaagagcacgtcaagcgctttgggacatgcaacggtcaccacggccaataaccttggcgcaaaatgcattattacgccatccgtatccggcgcgacggcaagagtggtatcaaagttcaagccgaggaccgagatcattggcgtgacgccaaatgaggcgactttgagaagaatgcagatctattggggcgtaaggccattaaaatccatagaattcagcaccacggaagatatctgcaacggagccatcgaactggtatgtgccaagcagatcgcggaatccggggatatcatcgtgctgacggcagggatcccttccccgaacgtacaggcccagaagaccagcgtcagcaatataatgcggattgcggtagtggattaaggagaattgtgaagttgtggcgccgctggcgagggcgggagggtgattcctgcgacgctttggtgcctgcatctcttgcacggagtcgtaagcctgatgaagagtcgccgatcgcggctcctctccaccaggctaacgtctccggcaaggatattccggacgccgccgcttacctccggaatcaccctcccgccctcgccggctcccggcaattcgttggcaattcttacgtggagtgcctgcgtttgggtacgccgttcgaagtttggggtggaagtcatggaaaataaaagaaaagaagccagtacaaaggaagaatgagacgatgttacagtctcccctgggtactggttttttattattttatgattcgagtcaataaccggggcagaattgccaacgaattgccgggggcgtgtcgggagggggagggattctggagggaagcggatggggcggagaatccatgcctgagatgttaggccgtaggagaggagccgcgatcggcgactctcctgcagccttacagatcagtgcattagtcgcagccccagtagcgtcgcaagaatccctccccctcccgacacgcatacgacaaccaaaaaaattcaaaacatattgacagccgtctttctatatattatagtgttcccatagagaactactacagaagaaaggcgaggtgatcaggtggaaaaaacatcatttgtagaatatttgatggaatttggacttacccgacaggaagccagcatatatcagtgcctgcttggcgaaggcaaggttacagggtatgaggtggccaagctgacgggcatatcaagatccaatgcatataattcattggcgaatatgacggagaagggcgcatcctatctggtagaagagggaaccacgcgcaaatatgtgtcggtgcccttggaggaattctgcaagaaccggatacggaggctggaggagtctaaaaaatggctggtatcccatgagccgacggaaaagactcatttggaaggatacataacgatagagggcgcaaatcatattctggacaagatgcgcaacctgctgtcccaggtagagaagagagtctatattacctgtacccggaactatctgcttctgctggtacgggaactggaagagttaatggagagcaagaagaaagtggtgatcattacggatcagcctgcgacttttgagaatgccaaggtttatgtaggagaaaacagaggcatgcagatcggcatcatcgcagactccaagtatgtccttaccggcgagtatggggaggggagcatgaatacatgcctgtattccggccagaagaacttcgttgaattatacaagaccgcgctatcgaatgagataaaattactgtcaatacgagaggagaataagaacgtatgaagaaggagccatttgtaaccaaagaacagctggaagagattgtaaaagaatatccgacgccattccatctctacgatgagaaagggcttcgaagaaatatgaaggcgctgaaggaagcgttttcatggaacaagggatacaaggaatactttgccgtaaaggcgactcccaatccatttctgatcaatattctgaaggaatatggctgtggctgcgactgttcctcctatacggaactgatgctttcagaggccattggagtgacgggcgaggacatcatgttttcttcgaatgatacgcctgcggaagagtttgcctatgcggagaaactgggagcgatcatcaacctggatgatattacccatatcgacttcctggaacagaccatcggccatattccagaaaccatcagttgccgttataaccccggcggcctgttcaagatcagtaatgacatcatggacaatccgggagactccaagtatggcatgaccacggagcaattatttgagtcatttaaaatattgaaggagaagggggcaaaggaattcggaatccacgccttccttgccagcaatacggttaccaatgattattatccgatgcttgcgaagattctgtttgaactggcagtcaggcttcagagagagactggcgtacatatcaagtttatcaacctctccggagggatcgggattccctatacgccggaccaggagcccaatgatatccgcatgatcggcgacggcgtgcgcagggtatatgaggaagtccttacgccggccggcatgggagacgtggcaatctatacggaactgggacgtttcatgatggggccttatggctgccttgtaaccaaagccatccatgagaagcatacccacaaggaatatataggcgtggatgcatgcgcggtgaacctgatgcgtccggccatgtatggagcttatcaccatatcacggtaatgggcaaggaaaagattccctgcgaccataagtatgatattgcaggctcgctgtgcgagaacaatgataaattcgcgatagaccgaatgcttccgaagattgacaagggagacctgctggtcattcacgatacaggcgctcatggattctccatgggatataattataacggcaaattaaaatcagcggagcttcttcttaaggaggatggcaccgtgcagttgatccggagggcggaaacgccggcagattattttgcgacgtttgactgctttgatgtcggaaagaaactgctggcagaataatttcagaattatattgaatgaattaggtaatgaattaggtaaaggaggaaaaagagatgaggaagaagggattgcttgcggcgctggtcatccttgcgatgatggtgctgagcgggtgcgggatgagcgcagaggacgctcagtcctatgccaagtcagtcttggacgccaactataagggggagttcaaagactatgtagaatggaccaagtcctctgagaaagaggcaaaagaactgtatgaggagaacatcgacacgaccatgaaggagtctgggcttaatgacctgggtctttccgaagaactgtcagccaattacaggcagatgttcgtcgatatggtgaaacaggcaaaatatgaggtgggagaggcaaaagaggccgatgacgatgcctatgccatcgaaataacggtagagcctttcacaggatttgacggcattcaggatgaagtgaccgcaaaggttacggaagaagtcaggaatatggaagagataccctcagaagaacagattaatgaactcttctatcaaaggatgtacgacattatggcagagagggtgaaaagtccgactttcggagagaaggagagcgtaaccgttcacgtaaagcctgactctgacggagtatactacattccgcaggatgaactgaccaagctggataatgccttgttccctgctgacaatttgtaattgcttgataaatgccgtcctttggcttgtgcgccatggggatgctaaacggactcgaatagaaaaaccgcaatttcacagattggaattgcggttttttaaatactcccttgcctattaacataactcaaaaatcatggactataaagtggaaatatatggaaataatttcatatagcatgtttctaaactatcaattttacagaattaagaacaaaaaagcgctagatctcttcttataaaagagatctagcgcttcgccagaatgcggatggtgggacttgaacccacacgaggtcgcccccgcaagattttgagtcttgtgcgtctgccattccgccacatccgcctgtaccgccgttatctccggcagcaacatgataaattataacctcaaaaggaagggttgtcaatccttttgtctggaaattttattcaaaatttcagccgtttatggtataatataacggatttgcacgaagtgcagaagtaagagagactcggagagcgtgctgctccgggatgggaggaagagatgtattacaagcaatatggaaatacaggattaaaagtgtcggcgatcggtcttgggaccatgcggtatgacgaggaggatatcaaagcagggaggcttgaaaaatgcgccgagattcctctttatgcctttgaaaaagggatcaactattgggatacggctccgaactattgccacgataagagcgagattgtcactgggatcgcactatcccagataaaaagaagcgatgtatatgtaacatcgaagacaaatctgggcacactggatgtaggagaccatccgacaaaggaggatttccgcaggcggctggaactttctcttgagaggcttaaaaccgactatattgacttttatcatatgtggtgcatgctcagcctggaatcctgggaaaagcacatggacgccttgtacggcttttttgaagaagccaagaaggacggactgatcaggaatatcgtattttcttcccatatgcagggaaatgagatagagaaagtggtagattccggcaagtttaagggaatgctgatagggtacaatgcgctgaactatcgtttccgccagagcgggatcaaggcggcttacaataaaggcatgggagtggtcgtcatgaatccgctgggaggtggaatgattcccgccaacccggacgccttccgctatctgacggaagggacagatttgacggttccccaggcagcgcttcgttttgtggcgtcccataaagagatcacggtgactctggcagggtgtaccacgaaggagcatattgacgatgcggtaaaagcggtggaacatctggaagagaagccgtcaaaagagatcgccaaggaatatgaaggcaagggagtggcgctaaatgacctgtgcacaggctgcgcctattgcaagggctgcccgaaggaaatccccattcccaaatacatggatgcctataaccagaagatactgaccgggaatgacaaggcaatcctggcgaggcttgacaatcattgggacattccaaaggaaaaggcggcagaatgcattgcctgcggaaagtgcgaaggacagtgcacccagcatctgccaatcatcgaacggctgaaagagattgccggcatgtagaaataaactccttttaaaaacgaaggatatggtgtatagtaatatggtaattttaaaataggtggagaatctgatatgaatagtaagattgttttgatagatggacatagcatcctgaaccgcgcgttctacgggctcccggatctgaccaatgcagacgggcttcatacgaatgccatttacggctttctgacgattatgttcaagatattagaagaagaaaagccggagtatctgacggttgcttttgatgtacatgcgcctacgttccgccatgagatgtatgaggaatacaaagggacgagaaagcctatggccgacgaactgcgccagcaggtgccggtgatcaaggaagtgttaaaggcgatgggcattcggatcatcgagcaggcggggctggaggcagatgatctgatcggaaccttgtccaagcgatgcgcgcagaagggaatggaagtgtccgtcatctccggagaccgggatctgctgcagctggcgacagagcaggtgaagatccgcattcccaagacgaagcagggccgtacggaagtggaggactattatgcccaggatgtcaaggaacgctatcaggtaactcccacagagtttatcgacctgaaggcgcttatgggcgatgcctccgacaatataccaggagtgccaagcattggggagaagacggcgacaaagatcatcacggagtatcattcaatcgaagaggcgcatgcccatgtggacgaggtaaagccgcccagggcgtccaaagcattaaaagagcactgggatatggcggtcatgagtaagaggctggctacaatcaatgtggacgcggattttccatatgagctggatgaggcaaaacttgggaatatctacacggaagaggcctatgcttacttccagaaacttcagtttaagaatctgctgcagcgttttgacgtgaccgcgccatccaaccaggtggaggatgcgtttcgggaagttaaggatagaaaagaggcggaagccatattcgcggctgcaaaaggagccgatgagataggcgcgtgcatattcaaggatacccagaatgtgcttccgcttttcgcagggcaggccgggattgacggcattggactctgcttttctaaaaaggatgtctactgcattcgcgcgggtcaggggattgaagtatcctggcttctggagcagctggagggcgtagcaaaagacgcagggcgctttgccatgtttgacatcaaggaggctctggagcatatccgcattgcccgccaggataactgttttgacgtgacggtggcagcgtaccttctgaatcctctgaaaagtaattatacctatgaggatgttgcaagggaacagctgaacctgattatagaagataagctggatgcctggacgaaggcatgctatgaagcctatacggcgtatgccgcatccgggattctgtggaagagactgaaggaatgcctgatggacaggctgtttatggatatcgagatgccgctggtatttaccctttatgacatggaagtaaacggcgtgaaggttgaggctgaggcgcttaagtattacggtgaccagctgggtgccaagatcgtggaattggagaaggatatttatgaggaagcaggagaaaccttcaacatcaattctccgaagcagctgggcgtagtcctttttgagaacatgaagattccagggggcaagaagacgaagacaggctattctacggcggcggacgtactggagaaactagcgccggattacccaatcatcgcaaagatcctggagtacaggcagtatacaaaactgaagtccacctatgcggacgggcttgcaggctatatccgggaagacggacggatccacagcaagttcaaccagacgatcacggccaccggaagactgagcagtacggagccgaacttgcagaatattccgatccgtgtagaactgggaagactgattcgcaaggtattcatcccggaagacggattcgtcttcgtagacgcggattattctcagattgagctgcgcgtgctggcccattgttccggggacagccatttgatcgatgcctacaaggagaagaaggacatccacaggattacggcgtcccaggtgttccacattccgtttgacgaggttaccgaccagcagcggcgcaatgccaaggcagtcaattttggaatcgtctatggcatcagctcgttcgggctgagccaggatttgagcatcaccaggaaagaggcatccaagtatatagaagactatttcaccacctatccgggcatcaagatattcctggatgatacggtgaagcatgcaaaggagatggggtatgtggtaaccctgttcgggcgcaggcgcccggttccggaactgtcttccagcaattacatgcagcgttccttcggcgagagggttgctatgaatgcgcccatccagggaacagcggcggatattatcaagattgcgatgataggagtgggcaggcggcttaaggagcagaagatgaagtccaggctggtgctgcaggttcatgacgaacttctggtggaggcgtacaagccggaacttgaccaggtaaagaagatactgaaagaagagatggagcaggcagcatctttggatgtgccgctggagatagacatgcatacaggagataactggtacgaagcaaagtagaggtgtagacttatgaagattattggaattactggcggagtaggggcaggaaagacgcagatactggagtacctcaataacaaatacggagcaaccatctgtcaggcggatcaagtggggaagaaactccagaaaaagggaaccccatgctttgaggccattgtggagcatttcgggacggatatcctggatgagaagggcgagcttgacagagaaaggctggcagaaatcgtattttcgaagaaagaagaattatccgtgctcaatggcattatccatcctgcggtgaaggaagagatccgcaggaagatagccaaagaggagcggaagaatacgaatctgttcatcgtggaggcagcgcttttgattgaagataactatgaagagatctgcgatgaactgtggtatgtctatgtggaagacgagattcgtaaaaagcggctgatctacgcaagaggctatgatgcccggaaagtggacgacatcattgccgcccagctgccaaaggatgtattcctgaagcattgcgacagggtcatcgacaacaacggcgtctttgaggagacgaagatgcagctggatcagattgtagcagatttataagaaaggcagaatagacagattatgagattatgcagtattgccagtggaagcagcggaaactgcatctacgtaggagatgacgatactcatctgctggtggatacaggaatcagcaagaagagaattgagcagggattacatacattaggaattaagggagaagaactgaacggcattctgatcacccatgagcatgtggatcatatccaggggctgggggtattcagcaggaagtacgggatacccatctatgccacccgggggacgattgagggaatccgatgctgcacaagcctggggaagatgccggaaggactgctgcatgatgtcccggtggatgagacattttcacttggaggcatgagcatacggccttttgcgatctcccatgacgctaaggagccttctggataccggatcgagaatgagacgaaatccgtggcggtagcgacagacctggggaaatacgacgaatacacggtagagcatctgaaggatctgaatgcggtagtcctggaggcaaaccacgatatccacatgcttgaagtaggtccctatccctatcctcttaaaaggagagtggcaggagataaaggacatttgtcaaatgaattgtcaggcaggcttctttgtgatatactgcatgacaaccttcaatatgtggtgctgggccatctgagtaaggagaataattacgaagaactggcctacgagacggtcaagctggaggtcagcatcggtaacaacccatataaaggcgaagatatccctatgatggtagcaaagagggatatggtatcagagattataacattatagcgacatgacacagtaggaggataagacaatgaagaaatgcgtgattacggttgtaggaaaagatacggtgggaattattgccaaggtttgtacatatctggcggagacgaatattaatgtactggatatatcccagacgatcgtcgacggatattttaacatgatggcgatcgtagatgttaccaaatccagcaaagagattgcgacggttgcgaaggaactggaagacctgggccttaccataggagtgacgattcactgccagagggaagagatatttgaaaagatgcacagattataagactacttaagaaaggccagggcatgcaaactatgataaacagatatgaagtatatgagacgaaccagatgatcgagcaggagaaccttgatgtaaggacgattacccttggcatcagcctgctggactgtattgatgcggatcttgagaaacttaatgaaaatatttaccataagattacgacggtggcaaagaacttggtgtcaaccggcgaagagattgaaagagagttcggaattccgattgtaaataaacgaatttccattacccctatcgcgctgatcggaggggcggcctgcaagaagcaggaagactatgtaaaggtggcgaagaccctggatgctgcggccaaggaagtaggcgtcaactttatcgggggatattccgcgctggtgtcaaagtctatgaccaaaagcgatgagatgctgatccgttccattccggaagcgctggcgtgcacggagcgggtgtgcagttccatcaatgtgggctctaccaggacgggcatcaacatggacgcggtacgcttaagcggagagattgtgaaagccaccgccgaagcgacgaaggagatggattccctgggatgtgccaaattggtggtcttctgcaatgcgccggatgacaatccgttcatggcaggagcgttccttggagttacggaaggagacgctgtcatcaatgtaggagtcagcggtccgggagtcgttaagcacgccatagagcaggtgcgcggcaagggatttgaaaaattatgcgagacgataaagaagacggcgttcaaggttacaagggttggacagctggtggcaggcgaagcgtccaaacggctggggattccttttggaattgtggatctgtctctggcgcctacgccggctgtgggggacagcgtggccgagatattggaagagatcgggctggagcgcgtaggggcgcctgggactaccgcggctcttgccatgctcaatgaccaggtaaagaagggcggcgtcatggcgtcttcctatgtgggaggcttaagcggcgcattcatcccggtcagcgaagacaagggaatgatcgacgcggtgaagatgggagcccttaccatggaaaaactggaggcgatgacctgcgtctgttccgtaggacttgacatgatcgccatacctggaaagacaaaagcaactacaatatccggaattatcgccgatgagatggcaatcggcatggtgaatcagaagacgacggcagtccgcctgattccggttattggcaaagacgtaggagagacggctgaattcggcggcctgctgggctatgccccaatcatgccggtgaatgagtatgattgcagcgcctttgtaaacaggcagggaagaatccctgcgccgattcacagttttaagaattagagaggatgtttggatgggaacaatagcagttgtcacggacagcaatagcggtattacccagaatgaagcgaaggagctggggatccaggtgattccgatgccgttctatatcaatggggaactctattatgaggatatcactttgagccaggaagagttctatgagaggctggcggaagatgcggatatatctacttcgcagcctgcgcctgcagatgtcatggaattatgggaggaattattggaaagctatgatgaagtgatccatatcccgatgtccagcggcctgagcagttcctgcgagacagcaatggctcttgcccaggagtttgacggaaaggtccatgtaattgataaccagaggatatcggtcacccagagacagtctgttctggacgcgattgaaatggcttcaaggggtctgagtgcagcgcagatcgaggagactctgatgcgcgaacggctggaagccagcatctatattaccgtggatacgctgaaatatctgaagaaaggcggcagaataacgcctgccgcggcagcgcttggaacggtgcttaatattaagccggtgctccagatccagggagagaaactggactcttttgccaaagtgcgaggatggaaagcggcaaaaaagacgatgctggatgcaatggaaaaggatatcaacggacgttttgccgggaaaaaggtacatctggaagcagcctatacctgctcggatgaagaggcgctggcatggaagtctgagattgagaagagattcccgggctatgagatacagctggacaggctgtccttgagcgtagcctgccacatcggcagtggggcaatggcagtagcctgcagccgggtaattgaatagagaagcataaaaaaggcaggcgccaaaaaaagagtaatctttttctggcgcctgcctttctgtccaggaaacacgtctagattctcacgatctgatgctgatattcattgatgaaaggcagcttgaacttgttcgtaatgatgctttcatagagattggaggcgaagatgtccttgcttagcatatttagccctgccggggttaagtcttccgtctgggtcaatttggtgatgatcggcacggaggaactgttcttcaggcaggagaggatctggccggcatccttgcggaatcccagaatgcgtgcatactgacagtagccttcctcctgataggagagcatgtcttcattggtgatatcaagcaggatatgaaacaggctgcggctgatgcgggtgtaggtcatatcccgggtcttgagaagatcgcagaactggtcaaacgtgatgaaatcattggcatggttcatgatccggttagccagatcctcggtcacatccttgtacttgaccagagtatcgctggtctcggtcagcagcttgtactttagaagaagtgaaaagtcattggagtagattggatatcgggtacggtgcatctcttccagaagacggatacaggacggaggcacctggccttccagccgggtcagcacctcggacatggcaggctcgtcaaacatgccttcctcctccagatggatggaactgctggcataggccagcagcttgcggatggcggacgcggaactgtagctgccggtcagttcctcatcgtggtagccggataccatgcgtttgatggtataagtcttgatgctgctttttttcttgtagagcgccttaatgtactcaatgcccagaatgttattgggctgttccagaatcacatccagggaatcatcctttaaataagcctttaaggccatctgtcttgcccgtggaaaggagatgccctttcttaacgcctcctgaagggagaacttatattcctccggctcgtcggcagtcacgcgggcaatcctttccagaactttgtagtctccgcattcgctgccaaaacagatggagtctatgcatcccagctgctcaaacagggagatggcgcccgcggcaaaatattcggcgcttccggaagcgtagcatacaggaagttccatgacgacgggcacgccggcttcgagggctacctccgctctcagatgcttgggcataatggccggagcgccccgctgcacgtagttgccgctcataacaacgactgccgcatccgccccggatatctcttttgctttttgaatatggtacaggtgtccattgtgaaatgggttgtattccgtgatcaatcctactattttcatgagaatctccttgtatatccttttgaaattgattatactatagaaagattggggatgcaatgaatgacaggagaggaggggatgcatagatgagcgaggattggaaggccgaccgtcaaaaggttgaagattctgtcgaagaatcaaagattatgccggatcttgcagaaacggactatctggaagaacgggaggaactgacggaagaacggatactggagatgctggaagagcgccagtataaggatttaaaggaagaactcgaaaataatatgtatcccattgacctggctgacatcctggagaattttgaccagaagcatctggttatggtattcaggcttctggccaaggaagaggcggcagagacatttacgtatatgaacagcgatatgcgcgagctgctgatcaatgcactgacggattccgaactggaagaagtcatggaagagatgtacttagacgatacggtagacgttctggaggagatgccggccaatgtggtggacaggcttctgatggccacggatgaggagacaagagtccagatcaaccagctgctccagtatccggaggacagcgcgggaagcgtgatgaacgtagactatatcgcgctgagaaaagagatgacggttgcagagtccatcctgaagatccgccaggtcggtatcaacaaagagaccatctatacctgctatgtcacggagaagcgcaagctgatcggccaggtagacgtaaaggaacttcttactaccagcgaatccaagacggtggaagagatcatggacacgaatatgctgtatgcgcatacgacggatgatcaggaagacgtggcaaggaccatcaccaagtacggcctgatcgcgcttcctatcgtggaccatgagatgtgcatggtgggaatcgtaaccgttgacgatgccatggttgtcctgcaggaagagacgacggaagatatcagcatcatggccggtgtcaatcccaatgaggagacttactttggcacgacggtattggagcatgtgaagagccgtattccctggcttctgttcctgatgctgtccgccacggtgacgcagatgatcatgaacagttatgaggcggcccttgcggtcatgccgcagctggcgggattcattcctatgcttaccggtactggaggcaattgcggctcccagagttccacgctggtcatccgggggctggcggtaggcgagatcgagtttaaggatctgttcaaagtcatctggaaggaagtgcgcatcgcggtgtgcatcagcctgatcctttcggtggttaacggccttcggatcctgctgatgggacaaggggatgcaatgatggcatttaccatcgggcttaccatggcatgcacggtagtgatcgccaaggtggtaggctgtaccctgcctcttctggcgaagaaagtgggactggatcctgccatcatggctacgccgctgatttctaccctggtagacatcagtaccatcagcgtatactttgccattgtcagtacggcatttgccctgtaggagattgtatgcaaaaatagacagaagattctacaaagagaccttgtttgcatggtctctttgtattataatagaaatactgagaaaatatggaatggaaaggagtctatcaatcatgggatttatagatgaaatcaaagcaaaagcaaaaacgagcaaaaagacaatcgtacttccagagacagaagacatcaggacttatgaagctgctgaagcagtactgaaagagggaaccgccaacctgattctgatcggaagcgaagaagagatcgctaagaacaaaggttctttcgatattaccggagcaacgattgtagaccctgcaacatatgaaaaaacggatgcatacatcgcgaaactggtagaactcagacagaagaagggaatgacagaggagcaggcaagagaactgctgcttaccaactacctgtattatggagtcatgatggttaagatgaaggatgctgacggaatggtatccggagcatgccactcgacagcagataccttaaggccatgcctgcagatcctgaagacgaagccgggaaccaagctggtatctgcatttttcatcatggtagtgccggactgcgatatgggcgcagacggaacattcgtctttgcggactgcggactggagcagaacccagatccagagaaactggcagccatcgcgctttcttccgcagagtcattcaggctgctgacagagaaagatccggtagtcgctctgctttcccattctacaaagggaagcgcaaagcatgcggatgttgacaaagtcgtagaggctacacgtatcgctaaggaaaatgcgccagaaggacttcttatagacggagaattccagctggatgcagccatcgttccatccgtaggagcgtccaaggctccgggaagcccggtagcaggaaaggccaacgtactcgtgttcccggatctggatgccggaaatatcggatacaagctggtacaaagacttgcaaaggcagaagcatacggacctctgacacagggaatcgcagcgcctgtcaatgacctgtcacgcggatgcagcgcaaaggatatcgaaggcgtagttgcgattacggctgttcaggcaatggcagaagagtaaatagaacggaaaataataaaagagaggtatagagcaaatgaatgtattagttattaactgtggaagttcatctttaaagttccagctgatcaactccgattctgaagaagttctcgcaaagggactctgcgagagaatcggaatcgacggaagtcttacttaccagccgcagggcggggagaagacaaagacggataaggctatgccgacccacacagaagcaatccagttcgtgatcgacgctttgacggacgataagacaggggttgtaaaaagtcttgacgagattggggcagtcggacaccgcgtggtacacggcggagagaagttcgcaagttctgtagtaatcacggacgaggttatgaaagcgatcgaagagtgcaatgacctggctccgcttcacaacccagcaaacctgattggaatcaatgcctgccagaaattaatgccaggcacgcctatggtagcggtatttgatacggccttccatcagacaatgccggaggaagcgtatatgtacggacttccttacgaatactatgagaaatacaaggtaagacgctacggcttccatgggacaagccacagtttcgtatccaagagagcggcggaacttgccggaaagccgtatgaccagttaaagacgatcgtatgccaccttggaaacggtgccagcatctgtgctgtaaagaatggcaaatccgtagatacatccatgggccttacgcctttggaaggcctggtaatgggaacccgttccggagatattgacccggccatcttagagttcatcgctaagaaagagaatcttgatattgcgggtctgatgaacatgctcaacaaaaagtccggagtatatggactttccaataacctttccagcgacttccgtgatctggatgcagctgcaagcgaaggcaacaagccggcagccatcgcgctgaaagtatttgcctaccgcgttgcaaaatatgtaggaagctatgcggcagccatgaacggagtagacgtgatcgcgtttaccgccggcgttggcgagaattctggcccggtacgcgcggatatcatgagttatcttggataccttggaatccagctggatgaagcagctaatgattcacgcggagaagaagtcaccatctccacgccagattcaaaagtacaggtaatggtaattcctacaaatgaggaattggcaattgcacgggaaacagttgcattagtttagaagattggtgttgacaaaatcattctacatgatataatagtctaggtgtgaataggagtattagttatgatattagacctatccaatgttctgtccgaacaacatagcacaattgaagagtccgttcctatcgagatgacaagtttccagtcagaagcaggaacgtttcccatcatttggaagtctcctttggccctgtgtatcgaatatgcaggcgatcaggaacttaagatagcaggaaagggcgacgtccgcgtgacgattccctgtgaccgctgccttgcagatgtggaagtggacatacctcttgattttaagagaaaggtatgcctggacccggagaatgtggagcggatggaagaactagacgaaaccaattatattgacggatataactttgacgtagaccagttagtttacaacgagttattagtagggtggccgacaaaaattctgtgtagcgaagactgtaaagggatttgcaatgtatgtggtcagaacctgaatgaaggtacctgtaactgcgaagatacgggcctggaccctagaatgtcagttatccgcgatttatttaagaattttaaggaggtgtaacctatgtcaatttgtccaaagaataaatcttctaaagcaagaagagacaaaagaagagcaaactggaagatgagtgctccaaacctggtaaaatgcagcaaatgcggcgaattaatgatgcctcacagagtctgcaaggcttgtggctcatacaacaaaaaagaaatcattcctcaggactaatgaggaaggcaaaatgccccgaacaggcgatgtctgttcggggcattttttggcatttttcggcagtgctgcctgtcagttcctattttctttataaaatcattgatttttataataatgtctagtagaattaatcctagcaatgctaggaggaatagaaatgtctgatattacaaacatagcactggatgctatgggcggggacaatgccccggcagaaatgataaaaggggctatagacgccatagcaaaggaacctttaatgaaggtattcctggttggacgggaagacgttattcaaaaagaacttgcaaattatcaatataataaagaacagatcgaggtggtgaacgctaccgaagtgattgagacggcagaacctccggtaaatgccatccgcaggaagaaagattcctccatcgtggtaggaatgaagatggtaaaggaaggcagagccgatgcctttgtatctgccggaagttccggcgcgatcctggttggcggccaggtattagtaggaaggatcaagggcgtggagcgtccgcctctcgcaccgctgatcccgacagagaagggcgtgacgctgctgattgactgcggagccaatgtggatgcgcgcccgtcccatctggtccagtttgccaagatgggatccatctatatggaacacgtgctaggcattcagaaccccagagtagggattgtcaatatcggagcagaagaagaaaagggaaatgccttggtaaaggagacatttccgcttttgaaagaagaaaaaggaattcatttcatcggaagcgtggaggcaagagagattcctcacgggcaggcggatgtggtagtctgcgaggcttttgcaggaaatatcatactgaagttatatgaaggcgtaggcgcagtgctgatccagaaggtcaaagaagggatgatgacaacccttcgcagcaagataggcgccctgctgatcaagccggcgcttaaggcaacgctaaagactttcgatgccagcgagtatggcggagcaccgcttcttggactgaacggtcttgtagtgaagacgcatggaagcgcaatggcaaaagaggtaagcaatacgctggcccagtgcgtaaccttcaaaagacagaagattaacgaaaagattaaggaatgtattcaatcggatgggacatccgttgaataaatacgacactatgtatgagaaaaggagaattggtatggaatttgaaaaattgcaggaaatcatcgcggacgtgttgaacgtcgagacggatgatattacgatggagactacatttgtagatgatctgggagcggactccctggatatcttccagattattatgggaatagaagagacatttgatattgagatcgacaacgaggatgctgagaagatcatgacggtaggcgacgctgtcgaacagattaaaaacgcaacaaataactaggcatttagaggatgaaaaagcccggtagggctttttcattttatggggaagattatgaatcaggaattgaaagaattagagaagaagatcggatatacattcaaggatttgcagctgttgaaaaaggccatgcttcacagttcctatgcaaatgagaagcacctccccaaatacgagtgcaacgaaaggctggagtttttgggagatgcggtactggaactggtttccagcgaattcttgttctatgagcatgagaagatgccggaaggagaactgaccaagacgagggcaagcatggtctgcgagccggcgctggctttctgcgccagagaactgtcattaggagagtacttgctgcttggaaagggagaagaggctaccggcggaaggaagagggagtctatcacatcggatgcgatggaggcgctgattggagccatatatattgatggtggttttgctagtgcaaaagagtttatacatcggtttattctgcaggacctggaggataagaaactcttttttgatagcaagactatcctgcaggagatcgtccaggcaaactttaaagaggcgatttcctatcggctggtgagggaagaaggcccggatcacgataaatctttccatgtaatggtctgcatcggggaagaggagtatggtcttggaaagggccgtaccaagaaggccgcggagcaggaggccgcctaccaaagcatcctgaaactgcatgagaagaacataaagtaggtgaagaatgtatctaaaaagtatagaggtgcaaggattcaagtcttttgcgcataagataaaatttgattttcataatggtattaccgggattgtaggccctaacggaagcgggaagagcaatgtcgccgatgctgtgagatgggtgctgggagaacagcgcatcaagcagcttcggggcggaagcatgcaggacgtcatcttttcagggactgaaaaccgcaagccgctcagttatgcgtcggttgcgatcaccctggataatagcgaccatcagcttcccatcgattttgaggaagtcacggtggcgcgcaagctgtaccggtcaggggagagcgaatatctgatcaatggaagcgcctgccgtctcaaagatgtaaatgaactgttctatgatactggaattggtaaggaaggatattccatcatcggccagggacagatcgataagatcttaagcggcaaacccgaagaacgacgggaactctttgatgaagccgcaggcatcgtcaaattcaagcggcgcaagaacatgtcggtaaagaagctggaggaggaacgccagaatcttctgcgtgtcaacgacatactggcggaactggaaaagcaggttggaccactggagcgccaggcagagacagccagggaatacctgaagaagaaagaacaattaaagacttacgatattaacatgttcctgctggagacggaccgcatacaggaccagatcagccagattgacgggaaacttactgttaccagaagcgagctggaagcagccagccagcagtatgaggacatgaagacagaatatgaggcggtagaggagcaggtggatagcattgacgcctctattgagaaggcaaaaagccagctgagcgagaccaccatgctcaagcagcagctggagaaccagatcgagctgctcaaagagcagatccacagcgcccgcatgaatgatgcccactacgaccagcgtgcaaggactattgattccgagattgatatccgggagaagcagctgaaagaactggaggccgagcaggatgcgatccatgcccagctggaagagaagacgaagttaaaagagcaggccaaggccgaactgatcgaggtacagaccaggattgccaccattacggcctctgttgaaaagaataagggcgatattatcgaactgctgaatagccgcgcctcaaccaaggcgaagatccagcggtatgacacgatgctggaacagatccaggtgagaaaagcaaggacgacccagcagatgatagaagccaggagcgagattcaggagcaggaagagcgcctggaaggatttcaaaaggagttaaaggaagtatctgctgagatcatcgtcctgtctgaggagaatagcaagcatgaagcgaagatccaggaactgcaagccttgcttgccaggcagacagaacagttccgcattgggcagaccgcgtaccacagggaacagtcaaggctggaatccctgaagaatattacggagcgttatgacggatatggcaacagcatccggcgggtaatggataacaaagacaaggagcctgggctattaggcgtcgtagcagatattatcaaagtagacaaggactatgagatcgccgtggagacggcgcttggaggaaatatccagaacatcgtcacttcggatgaggagacggcaaaacggatgatccagtacttaaagaagaacaagtatggacgcgccaccttcctgcctcttaccagcatccgcgcaaacggcggtatcagcagaccggaggcgttaaaagagccaggcgttattggaacagccaatacgcttgtcaaagtggatgccagatatcagaccctgtcagactatctgcttggaaggacgctggtggtagatcacatcgaccatggaacgtccattgccaagaagtacaagcagtctctgaggatcgtgaccctggaaggcgagttgatcaatccaggaggctccatgaccggaggcgcattcaagaactccagcaacctgcttagcaggcggcgggagattgaagaatttgaaaagacggttaagcagctgaagcgggaaatggatgagatggaagcctcctcggaaagcctgaggaaggaacgagccggatattatgagaagatcgatgagatcagcggcaagctgcagagagactatgtcattcagaatacggctaagatgaatgctgaccaggctatggcaaagatcaagaatgccaaagagatgtccgagacagcgcagaaggaagcagacgagctggatgcgcagattacggatatcatagataaccaggaatccatcaatgtagaactggatacatccgagacgctggaacaggaactgacccggcagattgaagcagagcaggaagtcctggatgcagtacacgaggaggaggccggcaagcttaagagcaatgaggcgattcatctggaatttgcaagcctggagcagaagttcacgtttgtgatggagaatacctcgcgtatccgggatgagattgaaaagttccagtcagaaattgcaggactggaagaaagcaaaggcgggacatccaaagagattgaggataaagaaagccagattgcggatctgcggcagacgattgaggattctaaggatctgtttgccgagattcagatggagattgaaaagtttaagcaggaacgggaggacttgaatcaaaagcacaaagtattcctgcagaaacgggaagacctgtcaaagcatatgtcagaccttgacaaggaaattttccgtctggacagccagaaggaaggctacgaggccgcttcggagaagcagatcaattacatgtgggaagaatatgagatcacatttaaccgcgcaagagaagtgcgggatacaaaccttacagacttatcaaagatgaagaagcgcatccaggaacttaaaagcgagatcagaggacttggaaacgtcaacgtcaatgcgattgaagaatataaaaacgtatcggaccgctatgaattcctgaaaggccagcatgatgacctggtggaggcagaggctaccctggagcagattatcgaagaactggatatagcaatgcgcaagcagttccaggagcaattccagctgatcgcgaaagaatttgataccgtattcaaggaactgttcggaggcggaaaaggaacgctggaactgatggaagacgaggatatactggaagcgggcatacggatcattgcccagcctccgggaaagaagctgcagaacatgatgcagctctccggcggcgagaaggccctgacagccattgccctgctttttgcgatccagaacctgaagccgtccccgttctgtcttctggacgagatcgaggcggcgctggatgacaacaatgtaggcaggtttgcccagtatctgcataaattgacgaaaaatacacagtttattgtcatcacccacaggaggggaaccatgacggcggccgacaggctatatggaatcaccatgcaggagaaaggcgtatctacgctggtatccgtaagcctgctggaagacgaattagatcaataggaggactatatggcagaagaacagaaagaaagcatgggttttttcaagcgcctagtgtctggcctcggaaagaccagggataatatcgtatcaggcatcgacagcattttcagcggcttttcccatattgacgatgatttttatgaggaactggaagaagtgctgattatgggagatctgggagttacggctacctatgatatcctggaagacttgaaggctaaggtaaaagaacagcatattaaagagccatcccagtgcaggcagcttttgatcgacagcatcaaggagcagatggatgtaggagagacagcctacgaatttgaagatcagacatccgtagtgatggttatcggcgtcaatggcgtgggcaagaccaccaccattggcaaactggcaggaaaactgcgggcgcagaataagaaggtagtcctggcggcggcagacaccttccgcgccgctgcgggagaacagttaaaggagtgggccagccgggcccaggcagacttgatcggaggccaggaagggtcagatccggcatccgtagtctacgacgcggtggcggccgctaaggcaaggcatgcggacgtgctgctttgtgatacggcgggacggctccacaataagaagaacctgatggaagagttgaagaagatgaaccgtatcattgaccgggaatatccggaggccttccgggagaccctggtggtgctggatgctaccacaggacagaatgccctgcagcaggccagggaattcaatgaagttgcagatattacgggaatcatactgacgaagatggacggaacggccaaaggaggaattgcggttgccatacaggcggaactgggaattccggtaaaatatatcggcgtaggcgagaccatcgaagatttacagaaatttgatgcagacacttttgtcaatgcactttttcagacaagcatagagtaatgtaaaccaaccaaactaagagagaaagagagggaattgcaatgttaacattggacaaatttgaacaggcaagcgaaatcgtaaaaaaggtaaccaaccctacaaaactggtctacagcgaatatttaagcagccagtccggcggaaaagtatacctgaagccggagaatatgcagtataccggagcatacaaggtgcgcggcgcatattacaagatcagcacgatgagcgaggaagaacgggagaagggcctgattaccgcatccgcaggcaaccatgcccagggcgtggcatacgctgcccagaagtttggatgcaaggcgaccatcgtcatgccgacgatcacgcctctgattaaagtaaaccgtactaagagttacggggcagatgtcgtgcttcatggcgatgtctatgatgatgcctgcgcgcatgcaatccagctggcagaggagaacggctatacattcgtgcatccgtttgacgacctggatatcgcgaccggccagggaaccatcgctatggagatcgtgcaggagcttcctacggtggattacatactggtgccaatcggcggcggcggacttgtaaccggcgtatccaccctggcaaagatgctgaatccaaagatccaggtgatcggcgtggagccggcagcggcagccagcatgacggcggccatcaaggccggggggcctgtgacgctggatagcgccaacacgatcgcagacggaactgcagtgaagcgcgtaggagaaaccatcttcccatacgcccaggagaacattgaccgtattctgacggtggaagatgatgaactgatcggcgctttccttgatatggtagagaaccataagatgatcgtagagaattcaggacttcttacggttgcggcgttaaagcagctggatctgaagggaaagaaggcagtgtccgtactaagcggcggcaacatggatgtgattaccatgtcttccatcgttcagcatggcctgatccagagagacaggatcttctccgtatccgtactgcttccggataagccgggcgagctggtgagagttgcggcaacaatagccaatgcccagggcaacgtcatcaagctggatcataaccagtttgtaagtaccaaccgtaatgcggctgtggaactgcgtattacgatggaggcgtttggaaccgagcataagcatgagattatgaaagcgctggaagatgaaggcttccgtcctcgcgaaatcggcgctaagctttattaaaaatgacgcctgagaatttagcgattcttatcataggcggtctgggagccttgctgctggtgatcggaatcgggatagcggcggcccaaaaaagcaagatccgtcattgtacaaagatgacagccgggcgggtgatcaggcatcgatatcatggcgacggacgggtgaatcctatgatagaatacgaagtagaggggcagatgtacacggtggcccggaagtttcgaggaatcatcacgaagaccaggatatccccagggaaactatacgaagatagcggcgcatacgtgacggaaaaggattatctgtatattcccaggagcgccgtgacgaatataaggcagatggcacaagacctatggccgataggaagcagcattaacgtctattacaatcctctgcggcccaaagaagcctacgccgaaaaaataccggcacagccgccggcagaaacacgcgtttttgctggcgccggcatcgggcttatgatactttcctttataatcgcttttttcattgcatcatagattgccgccttcatgcgggaatataaaatagcattcaatccatgaaaatgggctggatgctatttttttcatccagatattgacaaagggtgtataattgtatacaattatacatattaagtttcatactttactaaaacataatatctataaaggagagagaaagaaaatggaagataggaaagtgtatctggataaacattcgaacctgctgcagctggaagagcatatgtaccccttggtggatgttgaaaaacccaacatcttccgcaaccttttccactatgacgagatccccaagatcgcgttcaatgaccgtatagtgcctcacagcatgccggacgagatctggatcacggatacgactttccgtgacggacagcagtccagagcgccttacagcacgaagcagatcgtggagatctacgattatctccaccgtcttggaggcccgaatgggaagatccgccagtgcgagttcttcctgtatagtaaaaaggaccgcgatgccgtctataaatgtatggaaaaaggctatgattttcctgagattaccagctggatcagagcaagcaagaaggatttccaattggtaaaagacattggacttaaggaaacgggcatcctggtcagctgttcggattatcatatcttcttcaagatgaagatgaccaggctggaggccatgaaccattacctgtctgtcgtcagggaatgcctggagacggggatcagcccgagatgccatctggaagacatcaccagggcagatatctatggtttcgtaatccccttctgcctggaattgatgaatctgatgaacgagtataagattcccgtgaagatccgtgtctgcgatacgatgggctatggagtgaattatccgggagcggtgattccaaggtctatccctggaatcatctacggactgaggatacatgcaggcgttcccagcgaattgatcgaattccatggacataatgacttttacaaagcagtgagcaattccacgacagcatggctgtacggagcatccggaatcaattgctccttgttcggcattggagagcggacaggaaacacgcctcttgaggccatggtatttgaatatgcgcagataagaggaaccctggacggcatggatacgcgggtgatcacggaactggcagaatattacgaaaaagagattggatataaagttcctgcccagacaccgtttgtaggaaagaactttaatgtgacgaaagcaggaatccatgcggacggtctattgaaaaatgaagaaatatataatatatttgatacagataagttcctgaaccggcccccgatggtggctgtgtccaatacttccgggcttgcgggaattgcccactggatcaatacctacttcaagctgccggaagaaaaggctgtggacaagaattccgaactggtgaagaaggtcaaagagtgggttgatgcagagtacgagagcggccgcgtgacatcgctgacggatgaggaactgctgaaagtcattcatgagacatgccaggaattaggcataatctaattggggagatgtaggaatggaagagtatcatgaccactcattgcgtggaagagtatttcaaaaaatcagagaggatatcctgacaggcgtctacaaagagcatgacgagctgcgggaagtaagtattggggaagaactgggcgtaagcaggactccggtcagagaagcactgcggcagttggaactggaaggactggtgacgattgtaccgaacaagggagcctacgtcacgggaattacccctcaggatgtgcatgacatctacaagatccgttctcttttggaagggctttgtgccagatgggcgacggaacacatcacaggcaggcagatcgaagaactggaagagatcattcttctgtcagaattccacctgcgcaaaaagagtgccgagcaggccgaacaggtgtcggaactggatggaaagttccataaagtcttgtacgaagcctctaatagtcgtatactggaacacgtattatccgacttccataaatatgtccagatggcaaggatgatgtccgtaggagccaaagacagggccgagcgctccatagaagagcacagggacatcttaaaggcgatcaaggataaggatcccgataaggcagagtggctggcaaatcagcacatcatgaaggtaatggaaaatcttcatatggaaaactaacaatagaaggagagtatgcaagatggcaaagattaagatgacaacaccaattgtcgagatggacggcgacgagatgaccaggatcctctggaagatgataaaagagaatcttctggagccttttatcgagctgaatacggaatattatgatttgggactggagtacaggaatgagaccaacgatcaggttacggtggatgccgccaatgcgacgaaaaaatacaaggtcgcggtaaaatgcgcgactattactcccaatgcggcacgcatgacagagtatgatctgaaggaaatgtggaaaagccccaacggcaccatccgcgcgatcctggatggaaccgtattccgcgcgccaatcgtggtaaagggaatcgagccgtgcgtgaaaaactggaagaagccgatcaccattgccagacacgcatacggcgatgtatataaaggctctgagatgaagattccgggggccggcaaggtagaactggtctatacggctgaggatggcactcagacgaaggaactggtacataattttacgggcgagggaatcgtgcagggaatgcataatgtgagccagtccatcgcaagttttgcaagaagctgctttaactatgccttggatacgaagcaggatctgtggtttgcgacaaaagacacgatctccaagaagtatgaccatacgttcaaggacattttccaggaaatctatgacgcggaatatgatgagaagttcaaatcggcaggcatcgtatacttctataccctgatcgatgatgcggttgcccgcgttatgaagtcggaaggcggatatatctgggcatgcaagaactatgacggggatgtgatgagcgacatggtttcttctgcgttcggctctcttgccatgatgacttccgtactggtatcgccggacggctattatgagtacgaggctgcccatggaaccgtgcagcgccattactataagcatttgaagggcgaggagacgtccaccaactctgtggctaccatctttgcatggaccggagcgctcaggaaaagaggcgaattagacggtaattctgaactgatggaatttgccgacaggctggagaaggcgaccattgataccatcgaatccggaaagatgacgaaggatctggccttgatcactacgattgagaatcctacggtgctaaatagcgaggagtttattaaggctatcggggagagactttaagtggcttgatttgttttttcgaggacggacggtgcgggaaagggagatacatggcggtaaatcccacttgcttcgccgggaaagtataagtcaaaaaagcctcaaatctaagtaaccggacatattcggcgaaaaattctgaaagaatttctcacctcagatgtccggttacttagatttgaggctttttcgactaacgctttcctttcggctcgctcgacggacataccgccatgtatctccctttcccgcacctgacgttctctgataaagcaaaggagaggcgctggggttcctttggggatacaagggaggggcgctggggttacatttctttgctgaatttgtgtttgtagtaggcgtaggttaggagcatggcgattagggcggcggcgcttaggaggatggggatgaggggcgtgcgctgctcgatcaggatgaagatgattcccagcatgacgtagagcatgacgtcaaaggccctggctttggcctggctgatgatggcgatgttgcgttcgtcgtttttctcgattaattcccgcacgggctggcccagctgggcctgcttcttgtagatgtaggtagtgccgaaatagttgattccgaagatcatgcagatcatcccggcatagtggagtatagagaatagggtctgtatgggagcggaaaaggctcgcatgctatccagcatgccaaagacgaagtacaggataatgcctgctgccagcaggatgattttatttcttttttctttcattctgattcctcctcatagataaaaatatcttcaatattcatgtggaaataccgggcaatcttaaaagccagaatgatggaaggattgtaccgtccgttctccagggagccgatggtctgcctggagacttccaggatatcggccagttcttcctgcttaagcccgtgttctctgcggatttcttccagcctgtttttcaagaatattcctccttatctaatgtcaagtttactttccataattccagtatagcatgcaatatataaatgtcaagtttgctttccataacttcctgccaagatggttgagcggaagataaaattgtgctatacttttttcctggaaggagacttggatatgaaaagtaattgcgagtcctgcgctcattatgaatatgatgaagactatgaatgctacacatgccagatgaatctggatgaagacgaactctataaatttgtgaacaatacatatcatgactgtccctattacagttatggggacgagtatgcagttgtcaggcaccagatgtaaatgcaaaagaaaaggggagaagacaagatgaagatactgatgattaatggcacgatgagaaaaggatctacttatcaggtcgggaaattggcgattgaagagatcatgcaggaaggggaccagctcacagaactgttccttcccaaggatatgccggaattctgccggggatgcgctgcctgcatccgggagagcgagacgagatgcctggactatcttatgtacatgaagcggtttaccagaatgatcgacgaggcggatctgcttatatttacttctccggtatatgtgatgcacgtatccggcgcgatgaaggctctgctggatcattatggataccggtgcatgattcaccgcccggaggcatccatgtttggcaagcaggctatctgcatcgttacggctgccggaggcggcataaggtctgcgcttaaagatatcaaagacagcctgctgtattggggcgtagccagaatttacacccttggagtcaaggtgggaacctccggctttgaacatatggaacaggcggcaaaggatcaggtgacggaaaatatccggaagcttgccctaaaaatacacagagagcccgccgctgtaaagccggggcttaagacaaagattttattctatatcatgcgcaaggtggttcgggatggaaacaatccggctgaccagaagtattgggaagaaaatggatggcttgccaaggaaaggccatggaagaacaagactggccagcaggtggaagaatgatggatatcagactttattatgaaaaggcaggggatggggagccgttgatattgcttcatggcaatggagaagacgggacttatttcaagcatcagatggaatatttttcaaaagattacagagtcattgcaattgataccagaggccacggaaaatcgccacgaggagaaaagccttttacaatcaggcagtttgcagaagatttgaacggatttatggaagaacaggggatggaaaaggcgcatctcttgggattcagcgacggcggcaatatcgcgctcgcttttgcgctcaggtatccgggaaaagtggaaagcctgattcttaatggagccaatctctgccctgcgggcgtaaagccaagcgtgcagattccgatcgtcctggggtataagatcacatccttttttggcaggtttcatcatagatccaggcagaaggccgagatgctggggcttatgacaacccagcctgatctaagtccacggcagttaaaagaagtgaaagccagaaccctggtgatcgtgggggaaaatgatatgattaaggacagccactctgtgctgatttgtgaaagcctgccaaatgccaggcttgtaagaataaaaggagatcattttatagcggctaagaacccggaagagttcaaccgggcagtcagccgctttctaagaaattgtgattctattgtttgagcagaccgtattctgctttattccgcaagttcttcccatttctggtagagttcctccaattccccggcgatcctggccttttctgaggccagttcctggcatttgacggaattggtgaagatctcttcttgcatcatcagggagtcgatctcgccgtcccgctcttccagcagcgtgatgcgctcctctgtctttttcaattcattctggcgcttgcgttcctttgcctgggcttctttttgctcctgccagcttaatttggcttcggatacagtttctttggccgcagcggcatccgcgtcagggtcgccagcgtaggcggctgtcaattcgtcctttttttccagataataatcataattgccgatgtaattgacaaaggtccggttgacaagatccaggatcctggtggcagtctgattgataaaataccggtcatgggacacgtatagcaccgtcccggtataatcattcaatgccctttccagaatttccttggaaacgatgtccagatggttggtaggctcatccaggatcaggaagttggcctctgaaagcatcagtttcgcaagggagacccggcctctttctccgccgctcagatcgccgatacgcttgaatacgtcgtctccggtgaatagaaatgcagccaggacattgcgtatctccgtgttggtcagtgtaggatagtcgtcggaaatctcatcgaatatgctcttttccatatgaaggacatggtgctcctggtcataatatcccacatttacattggtgcccagggtaaatgtgccgttatcggccgggatgacctggttcaagatcttaagcagggtcgtcttgccggtgccgttatcaccgatgatggcaacgtgctccccccgcttgatttcaaaacttacatccgagaacaagggctgggaaggaaaggacttgcttaagtgctcgacgctcagcacatcattgccgctggtacaggatggctccagcgtcaggtggatttccgtgtttgcctccaccggcttttccaccggcttcattttttccagcatcttttcccggctttctgcccgccggatggatttctcccggttgaaagagcggagtttctcaatgacggcttcctggtgcttgattgcctgctgctggttcaggtattcctttaactgcgcatcccggatctgctcttttttctgggcatattcgctgtaattgcccagataggtcatcagttttccctgctcgatttccagaaccttggttacgacccggttcaggaaataccggtcgtgggacacgatcagtacggcacccggatagttcagcagataggtctcaagccatgcgatggaattcagatccaggtgattggttggctcgtccaacaacaggatatcaggacgggtcagcaggagctttcctaaagaaacccgggttttctgccctccggacaaggtatccactggcttcttaaagtcgctttccgaaaagccgaggcctttgagaaccccggtaatctcactttcataggcgtagccgttctcgcgctcgaaagccgccatcaggcggttatacgtctcgaggcgggaattaagggcatcgccgcttagatgcttcagttccagttcaatggtgcggatttgcttttccatggcaatgatttccgcttttgcaagccggacttcttcgtatatgctgttgccgctcatcatttcctgatgctgggccagatagcccaggcttttacccttggtaaggatgacatccccgccgtcagacggcagttctcctacgattatttttaagagagtggacttcccggcgccgtttggacccaccagggcagccttctcattatcctctatatgaaaagatccatcggccacgattacctcttcgccgaaggatttattgatcccgtgacatgctaatatcataatatcctccttcatacatatccgtttccattatatcgaaaataggacaaaatacaactaaaagtttgactttgctaccacaattctatataatgattcttagaacgatatgggaaggtgaatacgagtggaagatagagggatttctcaggcggtgattcgcaggctgccaagatactacagatatttaggcgaattacttgaaaatggtgtggagcgtatctcctcgaatgatttaagcaagcggatgaaagttactgcatctcagattcgtcaagatcttaacaactttggtggattcgggcaacagggctatggctacaacgtaaagtatttatatacagagataggcaagattctgggattggaagaagaccataatattatcattatcggagcaggtaatctgggacaggcattggccaactacgcggcatttgaaaagcgtggattcatattgaaaggaatcttcgatgtgaatccgagactggaaggcgtatccatcagaggcgtgccgatccgtatgatggacgggctgaagaccttcgtacaggagaatgacgtagagattgccgtgctgacgattccaaaggacaaagcaattgaagtggcaaatatgctggtggagaatggcgtgcgtgcaatctggaactttgcgcacacagacctgaatctgcccgagtatgtcattgtggaaaacgtccacttatcagaaagtcttatgcaactatcctacaatatcagcagatataacgaagaacataagaaatagcaagacgaaaacgtgtaatgacaggcatgtgcagacaggctggtctttacacgttcttttatatgttcaattattgatggaggtgatggaatgagatatctggctaatggccggcagatgaaggcggcagaccagtatacgatacaggaactgggaatcccatctatggaactgatggaacgggcggccttaaagtgcgtggaagtgatggaagcgcatagacttgatcttagcaggccctgcatcgtatgcggctcgggaaataatggcggcgacgggttcgccatcgctcgtcttctgaaccagaagggatatcctgtaaccgtctgctttgtgggaaatgaatcccaccgcacggaagaaaccaggagccagatgcggcttttaaaagaaacaggcgccgatatctgcaatgagtataagcctggcgaatatagtatcataatagatgctattttcggcgtcgggcttagcagggaaatcatcggacgctatcttaaggttatccgccagatgaacgaggcagatgccgtcaagttcgctgtggatatcccatccggcgtctctgcggatgaaggatgcatattgggagtggcatttcaggcggatattacggtgacattccagatggaaaaggtgggacttggcctatacccgggaaaaggatacgccggcaaggtcatcgtagcagatatcggaatcaatacggataagaccgtagcggatgtaggcgtggcttatacttatgaaccggaggaattccggaaactgctgcctagaagaatggaagattctaacaaaggaatgtatggcagactgctgatcatagccgggagcaagggcatgtcaggggctgcctacctgaatgcaaaggcggcttataaggcaggggcagggctggtacagatctatacgcccgaagataaccgaatcatcctgcaggagcttcttccggaggcgattgttaagacctacgatttttttgacgagggagaacttatccgcctgctgaaatgggcagatacggtatgtatcggctcagggatgggaaccagtgaaaagtctaagaaaatactgaagacgacgctggaaaatctaagcgtcccatgcctgatcgacgcggacggcctgaatctgatcgcggagcacaggaaatatatggaccggattccccatgatcatttgattatcacgcctcacatgaaggagatgtcccggcttacgggcatcagcgttttagaactaaaaagccgcaggatggagatcctaaaggagtttacagaaaagcaccatatcacctgcgtcttaaaggactccagcaccgtggtggcatcccccggggaacgcgcctatatcaaccgctccggcaacgcttccatggcgaaggcaggcgcaggagatgtgctggctggcatcgtggccgggcttatggcccaggggatggattgccaggaggcagggatcctggggacctacctgcacggccgggcaggggatctggcccgtcgggaaaagggcagctacagcgtgatggcgggagatttaatagaatatttaagtgaagcatttaaggaacaggaggaaaaaaattatgaacaattatactagaatctgtgcaagggtggacttggatgcaatagaatataatatggagatgatgaaaaagaacatcaaagaaggagtgcagatgatttccgtcatcaagacggatggatatggccatggcgcactgcagatcgcaaggatgctggagggcaaggaatatttatggggctatgcggttgctacgctggatgaggcagtcgttttgcgaaaaggcggaatcaagaagccgatcctggttctcggatgcatctttccggatcagagaaaggctatgatcgaaaatgagatccggatgactgtctatactgaagagatggcaaaagaggtctctgaactggcaggaagcatgggaaaacaggcatatatccatatcaagctggatacaggcatgtccaggctgggatttctgatcgaggatgagagcgtcgataagatcgagtctatcagcaagatgccaaacctgatcatggaaggcatgtatacgcattttgccaaggcagatgagacggataagacgtttacccattcccagatggatggctatctgtggatgaagaaagccctggatgataggggagtgactttcaagttctaccattgttccaacagcgcggggatcatagacgtcaaagaggcgaatctggatctggtaagagccggcatctctacatacgggctttatccatccagcgaggtaaagaaagaaaatgtgccgctgaagcctgcgatggagttgatcagccatgtggcccatgtcaagtgggtgaaggagggaacccctgtaagctatggcggaacctttattaccaagcgccccaccaagatcgcaaccataccggtgggctatggggacggatacccgagaagcctctccaacaaaggctatgtcctgatccatggaaagaaggccccgatcctcggccgggtatgtatggatcagttcatggtagatgtgacggagattgacgacgtaaagtacgctgacaaggttactttagtaggctgcgacgggaacgagaaacttccggtggaaatcttaagcgatctgtccggacggtttaactatgagttcgtctgcgaccttggaaagagaatcccaagagagttcatccgccacggcgaggttgtggaacagatggattggtttgcttaattgcctgatttgcaaactctatggaatacatccgaaaaagatggaaatactaattttatcttagaaaaatcggagtgtgaatagagtgcaagtaagacgcggagatatattttatgcagatctaagcccggttgtcgggtctgagcaaggcggcataaggccggttctgatcatacagaatgatgtgggcaacagacacagcccgacggtcatctgtgccgccattacctcaaggatgaataaggcaaaactgccaacgcatgtggagattgatgcaaagaaatatcagattgtcaagaattcagtcattctgcttgaacaggtaagaaccattgacaagcagcggctgaaggatttagtatgtcatttggataaagaaataatgaacaaagtagatgaggctttaaaaatcagttttgagcttcatacatagaaaaggagtttgaattagcaagttatggaagagggcggtttatttcaccggatgaagcagatattccaggtggaagaagagatggacgaagacacggttaaggaagcagccggtctgattcgcaatatattccggtatatggataaggacgcaaaggatattatgacccaccgcaagaacatcgttgcggtggatggcaatgagccgctggaagtggcgctgaagttcatgctggaggagagttactccagatttccaatatacggagaagacattgacgagattgtaggaatcatacatctcagggaggcgatgacctgctatctggaggaacgattaaggccggtgcctgtgaaggatctgaaggattacataaggccggttacatttattccggagacgaagagcattgacaccctgtttaaagagatgcaggcggagaaaaaccatatcgtcatcgtcctggatgagtatggacagacttcgggactcgtggctatggaagatattctggaagaaatcgttggaaatatcctggatgagcatgacgaggaggaagtgctgattacaaaaaatgccgacggcagctataccgcaaacggcatgatggatctggaagacttggaagacgtgattttcgtaaaatttgaaaaggaagagtatgagactttgaacggattcctgatagaccagctggaccggattcccggagaagacgagcaatgcgtggtcgaatacgaaggataccgctttacagtcctttttgttgataataacacaatccagagagttaagattgaaaaacgcagcgaagagtgatagaataggaaaagtgcgaatatacaacgaaatgataagatataaagtgaggtatgaactatgtcaggacattcaaaatttgccaatatcaagcataagaaagagaagaacgacgcggcaaaagggaagatatttacgaagcttggaaaggaacttgcggtagcggtcaaggaaggcggaagcgccgatccagccaataacagcaggcttcgtgacgtcatcgcgaaggcgaaagccaataacatgccgaacgatacgattgaaagaaatattaagaaagccgacagcgatgccaatgcggcaaattacgagcatattacatatgaaggctatgggccaaacggcacggcgatcatcgtggaggcactgacagacaataagaaccgtacggcctccaatgtaaagaatgcgttcacaaaaggcaacggaaatgttggaacgcccggctgcgtatccttcatgttcgacaagaagggacagatcgtagtagataaagaagagtatgaaggcgattccgacgaacttatgatgctggctctggatgccggagcagaagacttcgtggaggaggaagacagttacgagattctgaccgatccggaagacttcagcgcagtgcgccttgcaatggaggaggctggcattcctatggcagcggcagaagtaactatgattccccagacttatgtggaacttacggatgagaaggatatcgcaagcatccagaagactctggacatgctggatgatgacgacgacgtccaggatgtgtaccacaactgggatgaataatccgctttgacgggcaacggaggaagacagatggaagatacgaagaaggcgctggaatctttattcgacgagatgctgggcaatatcaaatactttaagaagaaatcctaccactccctttttgaaagcctttatgaagggcataaggaactattcgccacgatcgccaggaagtgcgagggggccgaagaggaggacaaggaaggtctgatagaagaactggcgtcagtgataccagaatatgcctatctgaagatgcaggaagtcccgaaaaggaagaaagagatgttttccgtggattataatatggctatggccgtgtatatagtcccgctgcttacctattcccgggatccggagtgcgaaagaatcgctgaccggatggtggaactgtggaataagaagcagattacatccatgaaactaggaagatcttcttttgaggatatcgccggaggattccggaagggcttctgctatatcacgactgcggtgtgcgaaagccagaacaagccggatgactgctatgaactgatgatgctcaggcactaccgtgacagttacctgatgcagaccgaagaagggaagcgtatcgtagaagaatattatgagatcgctccgcgtatcgtgcttgcgattggcatgcagaaagattcttccgggatctatgaagggatttacagggattatctggctccatgcatccattttgccgaatccggaaagaatgaagaatgtaaaaaactgtatatggacatggtgcgccatctgcagaccaaatatctatcttgaaattcacaggaggaaataaatgagcgattataagattgagacaaaatgcatccagtccggctaccagccgggaaacggcgagccgagggtgctgcctatttaccagagcacgacattcaaatacgattccagcgaccagatgggaagattgttcgatttggaggagagcggatatttctatacgcggctccagaatcctaccaatgacgcggtagcggcaaagatctgcgatctggaaggcggagtcgctgccatgctgacttcatctggacaggcggcaagcttctatgccattatgaatatcgtggaggctggcgatcatatcgtgtgcgcgtctgccctttatggcggtacatataatctctatgctcatacgattaagaagatgggcatcgatgctacctttgtggatccggactgcacggaagaagaactggacagcgcgtttcaagaaaataccaaggcggtattcggagagaccatcgcaaatcctgcattggtcgtgctggactttgaaaagtttgcaaaagcagcccattcccatggggttccattcatcgtagacaatacatttgcaacgccgatcaactgccggccgttcgaatggggagcggatatcgtaacccactctaccaccaagtacatggatggccatgcatcctgcgtcggcggagcgatcgtagacagcggcaactttgactgggatgcatatccggataaattcccgggacttaccacgccggacgagacctatcatggaatcgtgtatacgaagaaatttggcaaaggcgcatacattacaaaggcaacctcccagctgatgcgggacttaggctccatccaggcgccgcagaatgcgtttcttctgaatatcggccttgagacgctgcatctgagagtgcagaggcattgcgagaatgccttgaacgcggccaagtatctgcagggacatgaaaaggtagcctgggtatcaagcccatcccttccgggagacaagtactatgacctggcgaaaaagtatatgcccaacggaacctgcggggtgatcacattcggcctgaagggcggacgtgacgcggctgtacggatgatggacagcctgaagatgatcgccatcgtaacgcatgttgcggatgccagaagctgcgtgctccatccggcaagccatacgcaccgccagatgaacgaccaggagttaaaagaagccggcgttcagcctgatctgatccgattcagcgtgggaatcgaaaatatcgaggacatcatcgctgacctttcgcaggcgctggaacaggtataaaaattgcaaatacctccatactaaatgaaaaatgtatggaggtatttttttatggcagagtcagaacgcgaagagaaaaagacggaacagattaaggaaatgggcagtattaatctgaatgaaaataaggacaggcacagaatcaagctgctgacgatcataggagagatcgaaggtcatgaggcggtagccggaaacacgaaggccacgaagtacgagcaccttcttcctatgctggcagaagtagaagacagcgaagagattgaaggagtcctgattcttctgaacaccatgggaggggatgtggaggcaggactgtcgattgcggagatgatcgcatctttgagcaagcccacagtgtccctggtacttggaggcagccactctatcggaggcccattagccgtctccgcaaaatattcctttattgttccaagcggcaccatgatcatccacccggtccgctccaacggcatgttcattggagtggagcagagccttcgcaatatgatcaggacccaggatcggatcacaaggttcctttcccagcactcccatatgacccaggagagaatcgaagaactgatgctcaatcctacggaactggtgaaagacgtagggacgcttctggaaggtaaggaagctgtcaaagaaggactgatagatgaagtgggcggcatgagcgaggcattgaataaattgcacgaaatgatcgaccaaagcagacagaaaaagtatgaaaatatgtaatgacagccctttttaaaaatgatatactataaatagtattgccagtaataagggggaagtataatggctgctaagtccaagaaacgcaagagtacaaagcagacgaagaagaacacgcagcagagttttgtcagggacgagatcataatctgggtcacgcttgcagtcagcatcctgatgctgatcagtaattttggaatcggcggttttgtaggggaagcgatttcagatttcttattcaggatatttggatggattgcatttgtaatgccgttcatcctgtttggagcggttgcttttgtcatttcgaacaaaggcaaccttcatgcgtatatgaaagttgcgacatgcctgatcttaatggttctggtctgcacctttctgcagctggtggatgagaaaggcgggatgctgggaaatatccttgtggatgtcctggtacctgccattggcattgccggtacatatgtggtagacgttatcctgatgatcatctgccttgtgatcattaccgggaagtcggccctgaagggggtaaaggcccagggaggcaaggcatacgacaaagcaaggaaggatgccgagcgcaggcgcgagcaggcgcaagagcggaggaagattaaggaagcgcagccgaagaagtccagatctggaaagcgaagcgagaagcatgtggagggcgtctcttttgataccacgatagcgaagaagtcgccgaatgtaaaggaattgaccattgaccctatggaagaggacaggatgcaggagccgggcacgcacgctgtgaaggaaccgggcttcgtaatcaaccggggcgacatgccttccacagtttcggagccggaggcagagccggtgatggaagcggcgccttttgatgagacgccggtcccgaggaaaaggagcaagatggcctctgcagatgtggcaagcgaggtggcggatgtggctgccagtgtagccgcaagcgctacaaagccaaagaaagcctatcagtatccgcccatatccctgctaaagcggggcagtaagcaaagcggagaatcggatgcccacctgcgggagacggcgatgaagctgcagcagacgctgcagaattttggcgttaacgtgaccgttaccaatgtcagctgcgggccgtcggtcacccgttacgagcttcagcctgagatgggcgtgaaggtgagcaagatcgtggggcttgcagatgacatcaagctgaatcttgcggccgcggatatccggatcgaagccccgatccccgggaaagcagccgtgggaatcgaggtgccgaataaggagaactcggcggtgatgctccgggatctgctggaatccaaagagtttaagaacagcgcgtccaagatatcatttgccgcaggtaaggatatcggaggcaaggtggtcgtggcggacatcgctaagatgcctcatcttctgatcgcaggcgctaccggctcaggcaagtctgtctgcatcaatacgctgattatgagtattctgtataaggcaaccccggaggaagtcaagctgatcatgatcgatccaaaggtagtggagttaagcgtatataacggcatcccgcatcttatgatcccggtggtgacagatcctaagaaagcggcaggagcgctgaactggggcgtggcggagatgacccgccgctatcaggcttttgcagaatataacgtaagagacatgaagggatacaatgaaaaagtggcatccatgccgccggtggaaggaaaggcgctggagcggatgccgcagatcgtgattatcgtagatgagcttgccgatcttatgatggtggctcccggagaagtggaagaggccatctgccgtctggcacagctggcgagagcggcgggaatacatctggtactggcaacacaaaggccatcggtcaatgtcattacaggacttatcaaggcgaatatgccgtcaaggatcgcattttccgtatcctccggcgtagactccagaaccattatcgacatgaacggtgccgagaaactgttgggaaaaggagacatgctgttctatccgtccggatatcagaagccggccagagtacagggctcctttgttacggacaaggaagtgcaaggcgtggtagagtacctcaagaatcacaacggggatgttacatacgatgaggaaatcgtaaaccacgtcaatacaagttctgcggcaggaatgtccggggggcttggagcggaaggtgatgaccgcgacgtgcattttgtagatgcgggccgcctcattatagacaaggacaaggcatccatcgggatgctgcagcgtacgttcaagataggctttaaccgcgcggcccggattatggaccagctgttcgaggctggcgtcgtaggcccggaggagggaaccaagccaagaaaggtattgatgtccccggaagagtttgaacgatatgtagaggaaactgtctaaaaaacaaaagaaaggattggtagccgatgaaaacagatatccagatagcacaggaagcacagatggcccatatcaaggatgtggccgcaacagttggtattgaagaggaagaattagaattttatggaaagtataaggcaaaactttccgatgacgtatgggagaaagtcaaggacaggccaaatggcaaactggtcctggtaacggcgatcaacccgactccggcaggagaaggaaagactaccactaccgttggattgggacaggcgctggcaaagttggacaagaaggcgatcattgcgcttcgggagccatccttaggcccatgctttggcataaagggaggcgctgccggcggcggatatgcccaggttgttcctatggaagatttgaatctgcattttaccggagacttccatgcaattacatctgccaataacctgctggcagccttgcttgataatcatatccagcaggggaatgaattgcagatcgatccccgccaggtagtatggaagcgctgccttgatatgaatgaccgtaatctgcgtaatatcgtagtcgggcttggaagcaagatggacggaatggtaagagaagatcactttgtcattacggttgcatctgagattatggcaatcctttgcctggcagatgatatccacgaccttagaagacggcttggcagaattatcgtagcttataattttaatggagatccggtgactgcagaggatcttaaggcaacaggagccatgactgcgcttctgaaagacgccatcaagccgaacctgatccagaccctggagcacacgccggcattggtacatggcgggccatttgccaatattgcccatggatgcaacagcgtcagggcaacgaagatggcgctgaaattaagcgatatcacggttacagaagccggattcggcgcagacttaggcgcggagaaattctttgatatcaagtgcagaaaggcaggcttaaagccggatgcggtagttttagttgcaactgtgcgcgctttgaagtataatggtggagttgcaaaggcggatctgtccgaagagaacctggaagcgctaaagaaaggcatcgtgaatctggaaaagcatattgagaatatccagaaatacgatatccctgtagtcgtgactctgaattcgtttgtcacagatacagaagcggagaatgaattcatccgccagttctgccaggagaaaggctgcgaattcgcgctttccgaagtgtgggaaaagggcggcgaaggcggaatcgctcttgccaacaaagtattagatactttagagaataaagaaagccatttccatacattatatgaagatgagttatcattagaagaaaagatagagactatatccaaggaaatctatggagcaaggggagtcatctatgagcctgcagcgaaaaagcagctggccaagatagcatccatgggatttggaaatttgccggtctgcatggcaaagaatcaatattcattatcagacgatgcgaagaagctgggacgtcctacggatttcgatattcatatccgtgaagtatacgtcagtgcgggggcgggattcgtagtcgcgcttaccggcgctgtcatgacaatgccgggacttccgaaagtacctgctgcaaatgggattgatgtatcagaagaaggtaatattgtaggattgttttaaggggattataaaagaaatgataacgatgtatgataaaactggcagtaggaggttatcataagatgaagtgcaggtattgcggacacgagataccggatggaatgttgtattgtgaagaatgcgggaaggaagtccgcattgttcctgactataatccgttagatgatatgcttaccgctcaggtgaaaggtgccatcagtggggagaatgattattctgaagatgacatctatgaatcagtaagaaatacgactgctatgggaagaagcaccggcgcaggaagatatacgtccgcagggcgcaggacggggacaggacgaaacggagtcccgggcagtactgcagggcgcagcgctaccggccgcaatactgcaggccgtaacacttccggacgtaggaatacttcaggaggcagtcttcctgagcgtgagagaaggcgcaggcaggcggaacgcaagaaagcattgcgccgcaagagaagaaaaagagcgcttatcatactggcagtgctggcagtcgcagttatcgcagcttgttttgccatatatcagacatcctatgcgggaatcgtaaataaggggtataaagcaatagatagcaaagagtacgacaagtcagaacaatatttccagaaggcaatcgctaaaaatggaaaaaaagcggaagcttatgcgggactggcaaaagtatatacgaagcaggacaatctggataaagcggagtccgtcttcctgaatgccattgaaaagcagccaaagaatacggatatctatgaagcctgcgtccagttctatatggacacggatcagaaggcagagatcccgctgcttttggaagatgcgcaggacaatgtcatggagacgcttgcgggatatatcgtgaaagggccgaaattcagcctggatgacagcgagacattcgaagatgtccaggaactttccttaaaagcgggaagtggatacaccatctactacactacggatgagacggatccgacggtaaagagtacgaaatatgcggagccaatccagatcggcgagggcgagaccgtagtttcggcaatcgctgtcaacaagaagggaattcccagccttccggtgaagaagacctatacggtggaactgccgattgaagacgcaccggccgtatcgccatctacagggcagtatgaatctgctacgcagatagagattaaggttccggaaggatatgaggcctactatacgatggacaaaagcgatccgaccaccgcttccaccaagtatgccggaccgatagacatgccggagggagagaccatattcaaggctattctggtcaatgcgaagggacgtaccagcggagtgactacccgcaattatgtattggaactttcacaaggagaatagagatgataaaaagagagcagcctgactgtttttgcattggcgaagacaggggctgcttttttactgcctgcattttttgtacgaaaataaaaacaagaaaatttgtaaaaatggttgtgttaataatttaacagatgtataatattgataaataattaacatatcatataaaaggagatgcggacaatgagtagatttacattacctagggacgtttatcatggaaaaggatgtctggaggaactgaagaacctaaagggaaagaaggcaatcctggttgtcggaggcggctcaatgaagcgtcagggattcctggataaagccgtcggatatttgaaggaaggcggcatggaagtagaactgtttgaaggcgttgagccagatccatctgttgagacggttatgaaaggcgctgaggcaatgcgtgcttttgagccagactggatcgtagcgatgggaggaggatctccaatcgatgcagctaaggccatgtgggcattctatgaatatccggagaccacgtttgaagatctgtgcgtgccttttaacttcccggaactgagacagaaggccaaattcgcagccataccgtctacctccggaacagcgacagaggttacggcgttctccgtcatcacaaattatcagacgggcgtgaaatatccgcttgcagactttaacattacgccggatgtggcaatcgtagatccggaacttgtggaaggactccctgcgaaacaggttgcttacacgggaatggatgcgctgactcatgccattgaagcatatgtatctactttgaactgcgcatttacagatccgcttgcgttacaggcaatcgagatggtattcgattatctgccggcttcctatcatggcaatatggtggcaagagaacagatgcactacgcgcagtgcctagctggaatggcattctccaacgctttgcttggaatcgttcactccatggcgcacaagaccggcgcggctttctctaccggacatatcactcacggatgcgccaatgcgatgtatctgccatatgtaatcagatataatgcaaaagacgctacggcggcaaagcgttacgctgagatcgcacgccggatggggcttggcggaacttctgaacaggcgctgatcaatagcctctgcgagaagattgatgaattcaatgccaagtttgacattcctgcgacattgaaggaattcggaatcaaggaagacgaatttaaggagaagatcgccaagatatccgaacttgctgtgggagatgcatgtaccggttccaatccgagggcaattgatcctgcaacaatggagaaactgtttacatgcatctattatggaaccgaggtagacttctagggaagggtacaatcttaagtgtacataaaaagacggcttatcaagaaaaagatgtgcaaaaaaatcttgataagctgtttttgcggatgtatagatgtcgaatgatacttgatattttcgcccggatacattatgatgaaatgagtattaaatattaggaggaaataagatgtacaagatagtaaaagccgagaaactggctgatgtgatttatcttatggatgtagaagctcctcgtgtggcaagacattgccagccagggcagtttgtcatcgttaagatggacgaaaaaggggaaagaatccctcttacaatctgtgattatgacagagaagcaggcactgtaacgattgtattccagcccgtaggcgcatctaccacgaagatagccagattacaggcaggagattatttccgcgatttcacgggaccgcttggacgtccgtctgaattcgtagacgaagatatcgaagacctgaagaagaagaaaatcctgtttgtagctggcggcgtcggagcggcaccagtctatcctcaggtcaagtggatgaaagagcatgggatcgacgtggatgttattgtcggctctaagacaaaagatatgctcattctggaagacgagatgaaggcggttgcaggcaattattatccatgtacggatgatggtacatatggccatgcaggaatggtcacgacgaagatcgagaaactggtggaagaaggcaatcactacgacgtgtgcgttgccatcggaccgatgatcatgatgaagttcgtctgtctgctgactaagaagctggagatcccgacaatcgtcagcatgaacccgattatggtagacggaacaggcatgtgcggcgcctgcaggcttcatgtaggcgatgagatcaagtttgcctgtgtagatggtccggaatttgacggacaccttgttaacttcgatgaggctatgaagagacagcagatgtacaagacggaagaagggcgtgcaatgctgaaattacaggaaggcgacactcaccacggtggatgtggccattgcggaggtgacaactaatggcagatgtgttaaaaagagtgcctgtcagagaacaggacgcaaaagtaagagcgacaaacttcgaagaagtatgctatggatataataaggaagaagctatggaagaggcggcccgctgcctgaactgcaagaacgccaaatgcattcagggatgtcctgtggcaatcaacatcccagggttcatctctaaggtgaaagacggggatattgaaggcgcctataaggtgatcggcgagtcttccgcgcttccggctatctgcggacgcgtatgcccgcaggagtcacagtgcgaatgcaagtgtatccgtgggattaagggagacccggtatccatcggaaaactagaaaggttcgttgcggactatgccctggagcatgatatcaagccacagaaggcagagaagaccaacggacataaagtggcagtcatcggttctggcccatccggccttacctgcgccggagacctggcaaaactgggctatgaagtgaccgtattcgaagcacttcatgaacttggcggcgttctggtatacggaattccggagttccgtcttccaaaggaaaaggttgtcaaaaaagagatcgagaaagtaaaagaattgggcgttaagtttgagacgaatgtagtgatcggaaaatccactaccatcgaccagctgatggaggaggaagacttcgaagccgtatttatcggctccggcgcaggccttccgatgtttatgggaatcccgggcgagacagccaacggcgtattttctgccaatgaatacctgaccaggagcaacctgatgaaggccttcgatgattcctatgatacaccgatcgtggcaggcaagaaggtcgcggtagtaggcggcggaaacgttgccatggatgcagccaggactgcgctgcgccttggagcggaagtgcatatcgtataccgccgaagcgaggcagaacttcctgccagagtggaagaggtgcatcatgctatgcaagaaggggttatcttcaaccttctgacgaatccgaaagaaatccttgtggatgacaatggatgggtaaaaggcatgagagtcatcaagatggaactgggcgagccggatgcatccggcagaaggcgtccggtagagattccaggttctgagtatgagatagaggtcgatacggtgatcatgtctcttggaacctcgccaaatcctctgattgcatctacgaccaaggggcttgagaccaataagcgcaagtgcatcgtggctgaagaagaaaacggccagacctccaaagcctgcgtatatgccggcggagatgccgttacaggagcggccaccgtaatcctggctatgggcgcaggaaaggctggcgcaaaaggaatccatgaacttttaaaagataaataaagccgggatcaggctgtatcgaataggggccaggcgccttaaaaagcgccggggcctctattctgcgttttatggatccctaaaattgaatttcccccctgtacccgtaaggacggatatggtatgatgaggaggaatgttataagaaaagaggttataaatatgacaatattttggggcttgatcatcccttttataggaactaccgcaggcgcggcatgcgtcctgtttatgaaaaatgaactgaagccggtaatccagaaggcgcttcttgggtttgcggcaggggtcatggtggctgcttccgtgtggtctttactgataccggccatggacatgtccgagcatatgggcaaatttgcatttgcaccagctgccattggatttataatcggaatcgcatttctgcttcttctggaccgcatcattccgcatcttcatattggaagcgatgaatccgaggggccgagaagtacgttgaaaaagtccaccatgctggtgcttgccgttaccatccacaatattccagagggaatctccggaggggctgtttttgccggacttcttacgaataatgccaatgtgaccgtagctggcgcattcgctctgtctatcggcattgccatccagaacttgccggaaggcttcatcgtgtctcttccgatccgcagcgagggccatggcaggggcaaggccttcctgtatggctccctgtcaggcatcgtggagccgattgccggagggattaccatattgctggcagcatacattacgcctattctgccatatcttctggcgtttgccgccggagccatgatctatgtagtagtggaggaactcattccagagtcagcggaaggagagcatagcaatatcggaacaatcgggtttgccgtgggattcgcattgatgatgatactggatgtggcgttgggataaggaggcgttatgcgaaagaagatccgtactgcagatgaagagatgaggaatgttggatacctcatcctgttttccatactctggtattcgcagatcctatcctcaattgccagagacggctttcatactaccttgctgatcttcctggttgcggggctgatgccgctcatacaggtattccgcatgatccagaaagcaatgtattttcgtgattttcacaggcaatgcgtgaatgaaagccggccccagcaggggagaatcgtgaacattaccagagaatattatgatgattatcaggaaagccgcagataccgcagaacctattatttcctgattgtcgaaaccgtggatccggagacaggcattgccaatacgataaaaagcgagccttaccggattcctgtctataagtatctggggtctccctatgtgcaagtatacacggaccgtaccggctggaagcatgtcatcgatggattccagttaaagaacagccgaagcgagcccgacatccctttggagaattccaatgtgtatctaaaggattttaacaagactccatcgatcttaaactggatattcatcattatcttcgtgctgatactgctgcaaagtttcggagtacttaagtaagagaggaacaaagatatgaagattacattggtaacggtaggaaagatcaaagagaaatacctgaaagatgcgattgcggaatacagtaaaaggttgggcaagtattgcaagctggagattattgaagttgcggatgagaagacccctgagaatgcaagcgccacggtggaagatatgatccggcaaaaggaaggggagaggatccttaagtacataaaagaagacgcctatgtcgtcgctctggcaatcgacggccagatgctttcctccgagaaactggcggagaagatcaatctactaggaatacagggaaccagccatatcgcgtttatcatcggaggctccataggcttaagccaggaggtgctaagccgcgccgactatcagcttagcttctctaagatgacgtttccccatcagctgatgcgggtgatactgctggagcaggtgtacaggagctaccggatcattaccggagagccctatcacaagtaatcttaaattgccaattattacttgtattattattaaagttcttgtgttactatcttgcttgtaacaaatatgtaataaatcgataatgaaaatgtaacatttatcgagagcaaggaggtaatatgaagaaattatcagtattagcaacgattacagccatggggattgcaggcagcgcagcgcttccggctcaggcggcagatatgaaccaggtttacgatcaattaaaaacgaatggatatgcagtgatcggcggacaggtaaacagtccggaagatctgaaaaacatgatatccagtttaaatgataagtatcctggtatgaatattaactggggagactgtccggttatcacgccgccgggagaaaatactcctgacacggatcagccagattctgacggtggaaatactggtactccagatattgatcagcctggggatggcggcaatcagccaggaacggacacggatcagccagggacggatactgaaaagccaggaacggaagagcgcagttttgcggaaaaagtggcagaccttgtaaatgccgaaagggctaaggccgggctggatgctcttacaattgataaagggattgaatccgcggctcttgtaagggcgaaggaaatcgagacttcattttcccacactaggccaaatggcagttctttcagtaccgtcttaacagagaatggcattacattcagaggatcaggcgagaatatagcatggggacagcgcacgccggaagaagttatgaatggatggatgaacagcgaaggacacagagccaatatcttgaatccgaagttcaagaaaatcggagtaggattctatcagaatgcagagggtagaaattattggacccagctctttacttattaaaacgggatgttggaaaatcctttcgaaatagagtgagcaatcgaaagcatggcggttttaccgctgtgctttttctgtacatatgaaaaactacggactataatgaaaaaagaataggcagaaattatttgttaaatgtgctatactgttgcttaagagagtcataaggagaggtctgcaatctatgaaatccaaagaagaaaagtcaaatccgatatacccggaaggtctcaagacaggagaccaggtgtgcattattgatccagccaacgcatttaccgaggaggcattggatgcggccgcatctcatcttgaggcgcgggggttaaaggttaccgtgtcagaagatatggcatttcgcagagggacgccaaaggagcgtgcagagaagtttaacagggtgatcgaagatcccaggaatcgtgggattttctgcatatggggaggatatggcaccatacctttgctggataagatcaattatgacgcgttaagcaagaacaggcccatattcaccggattcagcgacattacggctatgcatctggcgatcggccaaaagacaggactggtgacctaccatggcccatccttttttagcacgagccggccgccaacggaaaccgcactgtgtaatttcctggatgtgctggcctcgcccgggaaagagcgggaacttaagaattttaatggagaagcctttgcggttttgaaggaaggcgtctgcgaaggacggattgcgggaggcaatatgactctggtcagccgtctgatgggaacgccttatgagatcgatgccagggaaaaaatcctttttctggaggaagtaggagagaagccttaccggctgcatgggatgctataccagctgaaacttgcgggcaagcttgacgaggcggccggagtcatcataggcagcctgacggactgcgatatcgaggggcggccagggagcgcggaggcaatggtaagggaagttttgaaagatttgcagattccagtcgttctaaatgtgcgggccggacatatcaaggacccgcttacgatacctatgaatggactggcaagaatcgacggggcaagagtgatcctctcggaacagatataaatgagagaaaaaaggaagcagggaagggaaagtatgaagaaaaagagaaaagtatggaagattatcggaggcgtgcttctggcgatcgttcttctgctggcggccgctgtcgcctatctgacaattcgggaatacaggccggatccgattgaggatatagcgccggggaagggaaacgccaggctgaatgccggggatgcatttacgattcttacgtataacaccggatatgcgggacttagcaaggacgaggacttctttatggacgggggctccaaggtcgagccggaaagcaagaaacttgtggaggataatctgaagggaatcacttccatcctgaagaagcaggaagcggatatttattttctgcaggaggtggaccgggattccaagcgatcctatcatattgatgaacaggcctattatgaggaagaacttggacttaaggggatgtttgcatgtaatttcaaatgtgacttcgtcccatatccgctgccgccgattggcaaagtaaccagcggcctggtgacgatgacggatctgaatgtcaaagaggcatccagaatctcgcttcccgaatccttctcatggccagtcaagacttgcaacttgaagcggtgcatgctggaggccagggtgcctttggaaggtacagacaaagaactggtgctgatcaacttccatctggaagcttatgacagcggggagggaaagatcgcccagagcaagatgctggcagagaagctggagtcagaataccagcagggaaattatgtgattgcaggcggtgacttcaatcagacttttgaaggaatggaaaaatacccgatccataataaggataagtgggtgcctggcatcgtaggcgctgatgacataccagaaggattttcctttgccgtatccgacaatgtaccgacctgcaggctgcttgacgggccttacagcgggaactatgatgaatcccaggtatatgtattggatggatttatcgtttctgataatatcaaagtgaataaagtagggaacattgatacggatttcgagtacaccgaccatcagccggtgcgtatggaagccatctgccttaaagatggacaatagaaataaaaaaatagcatcaaggatatagattatgaaaaccgaaaaattaaaaacttactatctgatcataggaatggtctgtctctgcttcctgacggcaagcgtaggctttaccttttattctatggaggaatatgaaaagaaggatatcagccatttcaaagaaaatgtagaaagcatgcgtaatagcgtctccaatatgataaaaggcaacatcgagattctggatggtatggctttgactattggacagatggagataacggatatcgagcatctgcagccgatcattaagaaggtcaatgacaggaatgccttccttcagatgggattcgtagatgcggatggaacaggggatatggtggatctggatgggacgatccatagagatgtggacttttccgatgagagtttctttcaaaaggcaatgggaggagagacggccatatccaataccttcaaagatgaatacaccaatggatatctgaattattatggagtgcctgtggtgatacagggagagacggtaggcatactggccgcggcagataaaacggacaggctgagagaagttctggatgttccgatattcaacaaaggcggatatgcgaatgttatagatgatcagggagcctatgtagtccgttccataaattctcctgcgatagaacatattgaggacatcggtgattttacagaagaagaattaaagaatatccacagggaactgaaagaaggcgaggaggatttcattcgattcaacaaagaaggaaagaaaacctgggccgcgtacatgcctctggggatcaatgactggtatcttctgggcattgtttctaaagatgcgacaggcagcgcctatcacctgtttgccggcatgatcatcatcgtaacgtcagcaatggccatctttatcttcctggtctactgcatcacccgggtgcaggtcaagaatgaaagagaactggaaaggctggcttatcaagacccactgttaggaattaataattatattaagtttaataaagacctgtcggagacgctggcgaaagaaggattccgaaagatcgctttctggtattgcgatatcgataatttcaaactctttaacgagtcctttggctatgaggcgggagaccagttgttaaaaagccttgcacagctgttcgatgagtgcgctaggaaagatgagttattctgccgcgagacatcagatcattatgtaggcatccgctattataaagaaccctcggaactgaaagcctggtatgaggaactgacggagaggctggaacattatcatatcttcaagcagcaatccttccgcctggtactcagcatggggttctattgtgcggatatgccggagtatctgcttacggtcaatgagatgtacaatagagcaagaattgcccagaagaccgtcaaagagaagaagaacattaaatacgcattttattcggacagccttcacagccagctgctgcgcgaaaatgagatcgaggccaatatgaaccaggcgctttgcgaacatcgattcaaggtctatgtccagcctaaggcagcgttggcagatgacaaccggatatctggcggcgaggcgctggtacgctgggcagatccggaaaaaggcatgatcagtccgggagaatttatccctcttttcgagaagaacggcttcatcgtgccgttggaccggtatatgatggaaagcgtgtgccagtggctgcatgggtatatggctgctggcgggaggccgataaggctggcagtgaacgtttcaaggcttggcatatttcaggaggattttgtagattattacaccaatatgaagaaccagtaccagataccggatggcctgctggaactggaatttacagaaagcctggccattgaagacaattcgttattgcgccagaggatcgatgaactgacggccaggggattcatctgctcgctggacgacttcggcgcgggatactcctctcttaataccttgaaagaccttgcgatccaagtgttgaaactggacatgctgttctttaagcgaagcgacaatgacgagaaggccaagattatcatcgcaaatatcgtccgcatggccaagcagctgcatatccgcgtagtggcggaaggcgtggaagagccagagcaggtagaattcctgaaggaatgcggatgtgacatcattcaaggatacgtatttgagcgtcccatgccctgtgatgaatttgaaagacttttatctaaggatcctcatggagactggggaagaggatttaaacgtacttagccatatggcgggagattactaatgataatgtttagacggatatgctggatcggaatcatatttctgacagcgaatattcctttcttaaaggccggaggaatcggattattctggcgcgtactgtgcgtgccggcctttattgcggttaacataatgccaaccattagaaacaggcggatggcgcgcttgcgttaccgtatctgcgcggacggctgcgaacttctaatatattttctggccgtagccgtggcatccacagttcttatgctcgctgcaataccagtttgctttccggctcagaaaggattatggcttgcgaatcttggatgtataatccttgtggaagcgatcaccttctggaacggcatcctgcgcgtatactgcacttccttgcagattggactgaaatggcggattatcggggtggtctgcgggtggatgccagtagtgcatttggctgtcctgtgcaagatcatacgggtggcatcttatgaatgcacctttgagaatgagaagattttaaagaatcaaagccgtaaggacgaggcagtctgcaagacaagatatccaattctcatggtacatggagtcttcttcagggactttaaatattttaactactgggggaggattccaaaggaactggaagaaaatggagcgaccatctactatgggaatcatcagtctgcggcatctgttgccgacagcgctaaggaaattgccatgaggattgaagagattgtcagagagagtggctgtgagaaggtcaatattatcgcccactcgaaaggcgggctggattgcagatatgcaatcagccgcctgggaatggatcggtatgtggcaacgctgaccactgttaatacgccccacagagggtgcgaatttgcggattatcttctggataagattccaggaggggcaagggataaggtggcggagggatataatgcggcgcttcggaaactgggggatgagaatcccgatttcatatcagcggtcactgacctgaccgcaacagcctgcaagaatctgaatgaaaagattccggatgcgcagggcgtttattatcaaagtataggatctaagctgaatgtagcatccgggggcagattcccgctaaacttctcccataagctggtgcggcattttgacggccctaatgatggcctggtatccgagacttccttcccttggggggagtcctatgtctttcttaccacagacgagagaagggggatatctcacggggatatgattgatctgaacagggaggacataagagggttcgatgcccgggaattctatgtgtcgctggtcagcgaactaaagcagaagggatattagaggcgaggtttgtagaaacttgcgatatattttcctacattctgacaggaaaatcaggtacaatatacttgatattgttaggaagggaagtatagaaaatgcgagaaaaagagtggacgatctgtatctggattcatcatatagcaacatttatcgggctgttttccagcctgtatcatattgccgcaggaaagaagcggccggcggcaaggagtggcggcctgattctttttgcctgctgccaggcctttggcgtgtttaagatagttgccgacctggcaaagggaagatcccggcttcggaaaagcttcgagaatatacatagcctgtgcagagataagaggcaggaaagaggcctgctgtgggtgctgaccgccttgtcggccgtttttaagacgagcacgccttgcctgttaaagtaaggggccgcctttataaaatccagggccgtccatgcataatcgccgtccatctctcatagattactataaattctatgaatggcgcttttatgaagacgaaaaaaaagggaccaaggccagaacctgatggccattctttcaaaaataaaatggcggaattatccgaacttcccaaagatgtggcgcttggaatgccggttctgacggttttagggcagatggaattaagccttgaaaattacagggggatcatcgaatataccgatacgctggtaagaatccagacaaaaaatggacagatcaaggtgactggaaagaggctccaggtggcatattataccaatgatgagatgaaagtgaatggacatatcgagtccattgaataccagcattagaggaggagacaatattgctgttaaaaatcatccgttatataaaagggtatatccgcatccgggtcataggatattccgcagaaagatttttgaatgcatgcagccacaaaggcatctttctctggggcttgaagccggtggacggagcttacgaaatgaatattacgataaagggattccggcagttaaagccgattatcaggaagacaggaacaaaagttgtaattgtgagacggttcggtcttcctttttttttacacaaatatcgaaagcggaaactgttcttcggcggagcctttcttttcattgtcatgattatagcgatgtcccggtttatatggaatatagacattacaggcaaccagtcgcggaccgatgaatccattctggaatttctgggctcaaaaaatgtagaggatgggatgccaaagtcggatgtagattgcgcccgcattgtaaaggatatccgcaaggagtatgatgatatcatatgggtatctgcgtccataagaggcacccgcctgatcatccaggtaaaagaaaatgaggattccctgccagtcgtcaataagacggaagaggaaaaagagcaggaagccaaggagaacgcaacggacattgttgcggaccaggactgcgtcataacagacatcgtacccagaaaagggattgcaatggtcaaagaaggagaccaggtgaagaaaggagatattctgatatccgggcaggttcccgtcaatgacgatgccggggagacgatcgcataccagtaccacgagtccgatgcggatatccggggacagacggccatttcctacgaggacagccaggaagtcacgtatctggaaaaggaatatttggacgtacagaaggaagaatactatattagagtcggcgaccgttttctcaggctggctacgatcaagaaccagtatgaggagtgggagatgcactccagggagcgccagctgcggataggcaagaacttttacctgccggtatcctatggcattcggactgccaatccttaccgttccgaagagaagaagcataccaagaaagaactccagcagatcttaagccttcgtttcaagcgttatcttgcggacttggagaaaaagggggtagaaattatcgagaatagtgttaaaatatacacagggcctgaaaaagccgaggcaaagggcacgcttacggtcatcacgccgataggcacgcaagccccgtctcaattgctggagattccggtgaaagaagaacaagaagagacaggagaataatgaatgggattaattgaagcgatcatggatataccggccgagcagcagagcaatgtgttcggacagtttgatgcttatgcaaagaaaatagagaggacgctccatgtgactctgatcgccagaggagagagcgtaaagatcatgggagaggcttccagagtggagcaggccaggaaggtcttaagccagctggcggaactgtcgcgcagagggaataatgtggaagagcagaacgtggactatacccttgccctcgtgatggaggacagcccggacagcgttctggagattgacgaggatgtgatatgccatacgctgcagggcaagccgatcaagcctaagactatgggacagaagaagtatgtggatgcgatccgcaagaaaatgatcgtgttcggccttggacctgccggaacgggcaagacctatcttgccatggctatggcgatcacggcatttaagaacaacgaggtaggcaggatcatccttaccaggcctgccatagaggcaggagagaaactgggattcctgcccggagacctgcagagcaagatcgatccctatctgcgcccgctgtatgatgcgctttaccagatcatgggggcggacagtttcttaaagaattctgaaaaaggcctgattgaagtggcgcctctggcttatatgagaggacggacgctggacaacgcatttatcatattggatgaagcccagaatacgactcctgcccagatgaagatgtttcttaccaggatcggattcggctccaaagtcgtcattacaggagacgccacccagaaggacctgccttccggccaggtatccggccttgacgtggcgatctcggtggtaaagaacatcgaggatattggcatctgtacgcttaccagcaaggatgttgtccgccatcctctggtgcagaagatcgtaaaggcttatgaagattatgagagcagaggcaagaataaaggcagggataaaaggagaagatcatgacactatactttgaagaagaaggggaggcaaggcttcccatagaatgcgaaaagatagcaagacaggtgatagagacagcccttgattatgccggatgtccgtatgagtgggaagtcagccttctgctgacgcagaacgaagagatccgcgtgatgaaccaggacttccgcggcattgacaggccaacggatgtgctgtccttcccgatgacggactatcccgtgcccgggcagtttgagtttttagaagactgcgatgactgcttccatccggaatcgggagaactgatgctgggcgatatcgtgatttccaaagagaaggtattatcccaggccgaagaattcggtcactctgctttgagagaatatgcttttttaattgttcattctgtgttacacttaattggatacgaccatatgcaggacgaggagcgtcagattatggaacgtaagcagaaagaaattatggaaagattaaatatattacgataagatggagtagtgtatggctgaacaacgtagaaagaaagagaagaatttcctggtccagggctcgatcctcgcgattgcgggggtgattacaaagattatcggggctgtgtaccggattcctcttaccaatatagcaggcgcggaaggaatcggatattacagcgtggccttctctatttattctgtggcattgatgctgacttcttacagccttcccctggctgtgtccaagctggtttccgccagagtggcggtgggggaataccggaatgcctataaggtatttaagggggcgatgacatttgccctgctggcaggcggatttgtatcccttctgatcttcctgggggcggactttatcgcttcccatatcatgcatatggatatgagcgcttatgcgcttcgggttctggctccctgtatcctgatcgtcgctcttttgggcgttctgaggggattcttccagggaaatggctccatggttcccaccgccatctcccaggtggtagagcaggtggtgaatgcggtggcatccatagccggagcatacttccttttgcaggcaggaaagagcattgccgagaccagagggaagaagtcctatggaccggcatacgcggcggcaggaggcacggtgggaaccgttttgggagccctggcggcgctgctgttcgttgcgctgatattctatgcctacaagcggatcttcaagcgccagatgaagcgggacaggacccgccggagggaaggctacaagaagatatacaaggttctgtttatcaccatcgcgccggtcatcttaagcgcgacggtctacaatatcagtgattttattgacacggcaatgtttaataacattatggctgcccagggatttaaaaaggtggaatacgcggaactcctcgggatgttcgggggccagtataccacgatgatcaatgtgcccctgtccatatcaagcgccctggctgcctcgctgattccaagcctggtagcgaccgtgcagaccggcaaccgcaagcagatacataacaagatcaatatggtatccagattcaacatgctgatcgcgattccatgcgcggtaggcttcgtgattctggccaagccgcttctggatcttttgtattttacccaggataatacgaagccggcactgatgctccagcttggagcgctgtccgtcgtattcttctgcctgtcgacggttacaaactccgtgctgcagggactggacgatatgatgaccccggtgcgcaatgccgccatttccctggtgatccacgtgattgccctgttccttatgatggtggtattcaagtggaacatctatgcggtagtcctaagcaagatcgtattttccggcgccagctgcatcttgaatgcccattctctgcgggaacgcatcggctatgtccaggagcgtaaaaagacgttcgtgattccgacgattgccgctaccataatgggagtcgtggccgttgtggtgcatctgctgtttgaactgtttgcaggcgcaaggattgcaacggttgtggcagtgctggtggcagtaatcgtatatggcgccgtactggtgctgcttggcggcgtgacggaagaggaacttctggatatgccaaagggagcctccatggtatctttatgcaggaaactgcatctgatccgcggccaatataggtaaagatcgtgtaaaaattgtccgcaaactgtataaatccggcaaaacaaaccgatactgtactaaaaaaggagttgtccttatgaaaaataagtatggtattggtttttttgcggctgcgattattgcggtgctggcggtttccagcgcatatcagctaagttatcagaaggcaaaggaacgcgcgcagacgcaagtgacaaaagaacaggaagagcctgctacgtccaagtcggaaccgacagtctctgcggatggccaggcgctaaaagaagactgctactatctgatggaagtcaacggctacgtggtcgtatatctgagcgataagaagactgcctacgaatatacggatatcctgtatgacgaacttccggcaaccatccgggaggagatacgtaacggtaaatacatggaaagcacggaggaactttatggctttttagaaaattattcaagctagaagtggacttccaaagtaagatagtgtaatataagtacgtaatttccgaatgaatcaagaaggaaggacaaaactatggaagaacagaagattgcaagaatcaatgaattatatcataaatccaaagcagagggcctgacggccgaagagtcaaaggaacagcagattctgcgcagggagtatatcgactcatttaagagaaatctgcgcagccagttaaacaatatttccatccaggagaaggatggaagcattacagatttgggtgagaagtttggaaagcaagaaggacattaggcatcgggttctggaagcccgaaaagaaatcagccccttggaatggcagaaggccacggaagggataacagctgcggtgacctcccatatgcgtttccgggaggccacggatatctactgctatgtagaccatcagggagaagcaggcaccaggctgatcatagaagaagcctggcggctgggaaaagacgtctgggtgcccagggtattgggacgcgggatggaatttttccatatagagaatttcggccagctgcaccccggcacgatggggattctggaacccgaggaaggcactttggctgaaggaacagacgcgcttgtcattatgccgggcgtggcttttgaccgtgacaggcgcaggatcggctatggcggcggctattatgacagatatcttgccgcgcatccttgccttcccaccatggcaatcgcatttgactgccaggtgctggatgaagtgccctatgatgaacacgatatcaggccgcagatcctggtgacggagaccagcgtatacgagaacggcaaatagaaaggcaaatagaaaggatgaggcttatgcagatagggcttcccaaagatcctatgctactattaagcgtagtaaatacgaaaatcagagattactatcattcgctggatgcactatgcgaggatatgcaagtagagagagaagagattactaatatactgaaaggaattgattatgaatacgacgaatccagacatcagtttgtctagcgcggcgccatgcgaggaaccgcagcgccagtattattacatagaaaaggccagaacctatattcagaagaagtccaaggaaattggccgtccgctgaccttctgcgtgaccaccttcggctgccagatgaatgccagggattccgaaaaactgcgaggaatcctggaaaggattggatatgaggaggcaccggaggatgtggcggactttgtcatctataatacctgcacggtcagggaaaacgccaatacaagggtctacggacgtcttggccagttaaagcccctgaagaaaaagaatccccatatgatgatcggtctttgcggctgcatgatgcaggagccggaagtggtagagaagttaaagaaaagctatcgcttcgttgacatcatcttcggcacgcataatatcttcaagtttgcggaattgatcgtgcagaggctggaatctcaggagatggttatcgatatctggaaagatacggacaagatcgtagaggatctgcccaatgaacggaaatatttcttcaagtcaggcgtaaacatcatgtttggctgcaacaatttctgcagctactgtatcgtgccttatgtaagagggcgggagagaagcagggatccaaaggccatcatccgggagatcgagcggctggtagcagatggcgtggtggaggtcatgcttctgggccagaatgtcaattcttacggcaagaacctgaaagagccaatgtcatttgccaggctgctaacggagattgagaagatcgaaggccttgagcggatccgctttatgacctcccatccaaaagacctctcggacgaactgatcgaggtcatgggcaattcaaaaaagatctgcaagcacctgcatctgcccatccagtcgggaagttccaggattctggagaagatgaaccgcagatataccaaggagcagtatctgacgcttgttgataagatcagaaaagccgtgccggatatctctcttaccacggatattatcgtaggatttccgggagagacggaagaggatttccaggagacgctggacgtggtccgaaaggtacgctatgacagcgcatttaccttcatctactcaaaacggaccgggaccccggccgcggccatggaagaccagattccggaagatgtggtaaaagaccgttttgaccggctgcttaaggaagtgcaggccattgccgcgcaagtttgctccgtccatgaagggtgcgtgcagacggccttggtggaagcaaagagcgagcatgacgattctatggtcaccggacggctaagcaacaatctgctggtgcattttaaaggctcgtcagagttgatcggccagctagttgacgtgcgcctgtctgaatgcaagggcttctattatctgggagaacaagtgtaaaaggcggcacatccgcgcttgcggcataagaaatatataccacccatattatgaacccaaaacgctcaaactatgtagtaagaacatatagtgagggcgtttttacatgaagaaattaagtgagtatctatttttatggacattcggcggatgcctgtattattcgtttgaagtgatcttccgcggattttcccactggtccatgtttattctggggggaatctgctttgtgttttttgcgatccagggaaagatggtgcattggcaggacgcgctgtggcgccagctgcttaggtgcatcgtctttgtaaccgcaatggaattcattaccggaattatcgtcaataagtggcttgggctggcggtatgggattacagcgatcagcccttccagctcttcgggcagatatgcctgccatttatggttatattttccggcctgtgcgttcttgggatcctgttaagcggctatcttacgcattggctctatggggatgagaagccccattaccatgtactttgacaaattgtatctttcatattaaatcgaaaaatgctataatgaaatgtaaaaatgtagacaaaagaggagaaataacgtggcagaattaacaccaatgatgcagcagtatatgcagacaaagaaagagtacccggactgcatcctattctatagattgggcgacttttacgagatgtttttcgacgatgccctgaccgcatccaaggaactggagattacgctgaccggaaagaattgtggacttgaggaacgggcgcctatgtgcggagtcccttaccatgcagtagacagttacctgaaccggctggtttccaaaggatataaggtagccatctgcgagcagatggaagatcccgcgacagccaaaggcctggtaaaaagggatgtcgtcaggatcgttacgcctggtaccaacttggatacccagtctctggacgagacgaagaataattatatcatgtgcgtggtctacatcgcggaccggtatggcctttcggtggcggatgtgacgacaggagactacttcgtcacagaactggatgacagcgagaaattatttgatgagatctacaaattcatgccctcagagttaatctgcaatgaggctttctatatgagcggcatggatctggacctgatgaaggaaaaactgggaatcaccatctattccctggatgcctggtactttgacgatgcgatctgccagcgtacgctgaaggagcatttccatgtcagcgccatggaaggactgggccttagcgactatgattgcggcattatcgccgctggagccctgcttcaatatctgatcgagacacagaagcgggacttatcccatattaccagactctctgcctacgcaaccggcaaatatatgctcctggacagttccaccaggcgcaatctggaattgtgcgagaccctgcgggagaagcataagagagggtctctattgtgggtgctggataagaccaagacggcaatgggcgcccggtgcttaagaaaattcatcgagcagccgctgattgataaaaattccattgaacgccggctggacgcggtggacgagctgaagcagaatgccatttccagggaagagatccgggaatacttaacgccggtctatgacttggaaaggctggtgtgcaagatcacataccagtctgccaatccaagagacctgatcgcttttaaaagttccctctccatgcttccgcatatcaagtacatattggaggagatgaagtctcccctgctgaaagatctctatgaaaggctggatacgctggaagacttatgccatctggtagaagaagctattaaggaagacccgccgctggcaatgaaagagggcgggatcatcagagatggctatcacgaggaggtggaccggctccgttcggccaagtccgatggaaaggactggcttgccaagctggaagcggatgagagggagaagacgggaatcaagaacctgaagatccgttataataaggtgttcggatactatctggaagttaccaattcttttaagaatatggtgccagactattatacaaggaagcagacgctcgcaaacgcggagcgttacatcattccggaactgaaagaactggaggataccatcctgggggcagaagacaagctgtacgcgctggaataccagctctactgcgaggtgcgggacaggatcgccaaagaagtcctgcggatacagacgacagcgaaagccatcgcccagttggacgccttcgcctccatggcccttgtggcggaacagagccgctatgtaaggccaaagattaatgaaaaaggcgtgatcgacatcaaagacgggcgccatccagtcgtggagaagatgattcccaacgatatgttcatatccaacgatacatatctcaacgataagaagaaccggatctctatcattacgggtcccaatatggcgggaaaatccacctatatgcgtcagacggccctgatcgtgctgatggcccagatcggctcattcgtgccggctgccagcgcggatatcggactggtggaccgcatctttaccagagtgggcgcatcggatgacttggcaagcggacagagtaccttcatggtagagatgacagaggttgccaatatcctgcgcaatgccaccagcaagagccttctgatcctggatgagatcggccggggaaccagcacctttgatgggctgagcattgcctgggccgtgatcgagcatatcagcagcagcaggcttttgggagccaagacgctgtttgccacccattatcatgaactgacagagttggaaggcaagatcgacaacgtaaataactactgcattgcggtaaaggaaaagggcgatgacatcatcttccttcgcaagatcgtcaaaggcggcgcagataagagttatggaatccaggttgccaggctggctggcgtacccgaaagcgtcaccagccgtgccaaggaaatcgtggaagaactggtacatgcggatatcaccaccaggatcaaggatattgcagtccatgggcaggagccgcccaggcttaagaccaggcattatgacgaggtggatctggcccagatgtccctgttcgatacggtgaaggacgacgacgtgattgaggagatcaagagcctggatgtcagcaacctgacaccgatcgacgcgctaaatacattgtaccagttacagaacaaactgaaaaacaggtggtaggacatgaacaagatacaagtattagacccggttacgattgataagatcgccgccggggaagtaatcgaacgccctgcgtcggtcgtaaaagaactggtggaaaatgccatagacgcaggggccacggccatcgtcaccgagattgaagaaggcggcatctctatgatccgcatcgcggataatggctgcggcatggatgcatccgatgtacccaacgcgttcttgcggcattccaccagcaagatacgttccgtggaggatctggtacatattggatccctggggtttcgaggcgaggcgctttccagcattgccgccgtctcccaggtggagatgatcaccaagacaaaggaccaggttctgggtacccggtaccggatcgcaggaggaaaggaagaagaactggatgagacaggggcccgggatggcactacatttctgatccgccagctcttctataatacgccggcaaggaggaagtttttaaagactcctatgacagaggcaagccatgtgggggatctgatgacccgaatggcattgtcccatccggagatctccttccagttcatcaataacgggcagtccaagctgcatacttccggcaatggcaatcttaaggatgtcatctatcatgtatatggcagagagattgcagccaatctgctggcagccgattatgaatcccccggacttaaaatcagaggatttctgggaaagccgctgatatcaaggggaaaccggaattttgagaattatttcatcaacggaagatatgtaaagagcagcattatatccaaggccatcgaagatgcgtataaggactttaccatgcagcataaatatccttttgtggtactgcacatcgagattgatggcgagcatgtggatgtgaatgtccatcctacaaagatggaattgaggtttaataatcagcaggaagtctataattctatatatgcggctgttgaccagggacttcatgcggaagagctgatcccgcatgtggaagtcgatgcgcctaagacggcagcgcccaggaagcaggagggcggagcgccccatgcggcgcagaagaaagataatccagtggttctcgatagaactactagcgcacagcccgcaccgtcggcaaaaaaatctgttccagcgccggaagaacgcaccctggactatttcatgcagaagatgaaggaacgggttgcggcatatcacgcccagcagaatcaggatgcgcctaagaaggagcctgatgttaaagtgtctgcccggccgtccgaagaccgcagggaagccccctcggaccgggtttgcgagacgccggaatatacggcccagcagcccacgtttttaaagcggacgccaagcccttcaaaaagtccagagcctccggcacgggctgcaatgcagcctgcggcccagcagctgaacttattcgaagagaatctggtggagcggaaggttcaggcagagtataagatcatcggccaagtcttcgagacttactggcttgtcgaatttaacgacagcctctatattatcgaccagcatgcggcccacgagcgggtgctgtatgaaaagactttaaagagcatgaagaccagggaatttacctcccagttcatcagtccgcccatcgtgctggatctgagcatgcaggaggcggaacttttaaaccagtatatggatcagtttacccgtatcggcttcgagatcgaggagttcgggcaggagtcttatgccgtaagggcggtgcccggcaatctgttcggcattgccaagaaggatttgctgctgcagatgctggatggcctgtcggatgaagtgagccgaaatctttcgccggatatgatcgatgagaaagttgcctccatgtcctgcaaggcggctgtgaaggggaatatgaagttgtcagccacggaagtggattccttgatcggcgagcttctgacgcttgagaacccataccactgcccgcatggacgcccgacgatcatcgccatgacgaagcgggaactggaaaagaaattcaaaaggattgtatagagatgaagaaaccattagtagttcttacagggtctactgccgtgggaaagacaaaagcctccatcgggcttgcaaaggcgatcgggggcgagattatttccgcggattccatgcaggtatacaggcatatggatatcggttcggcaaagatacggccggaagagatgcagggcgtgcctcatcatctgatcgatgtgctggagccgtcggaagaattccatgtcgtgcgctttcagcaaatggcgaaggccgcgatggaggagatctattccagaggacatattccaatgatcgtaggcggtaccggattctatattcaggcagtactgtacgatattgactttacagagaatgacggcgatgacgcataccgccaggaacttgcggactatgcggatgcaaatggcccattaagccttcatgagcgccttaggcaagtcgatccgaaagcagcggatgcgattcaccccaataacaccaagagggtcatccgggcgctggaattctgccatcagacgggacagaagatatccgagcacaatgagaaggagcgggagaaagaatcgccctataattttgtttattttgtcctgaatgacgagcgtcagaagttatatgagcgtattgacaggcgagtagatcttatgatacaggaaggcctggtagaagaagtgtcccggctaaagaagatggggtataccagggatatggtttccatgcaggggctgggatataaggagatcctcgcctgcctggacggggaatgcacgcttgaggaagccatctatacgattaagcgtgataccagacattttgccaaaagacagatcacctggtttaagagggagagacaggtaatctggattgagaaagaagcatacggctatgatgaagaaaagatactgcacacaatgataaaacatatggagggagtactatgtttagaagattattcgggggttccaaatttttaaaaaagatgaatacattgatggaattgtattcatgcagtcataacgcgccatctacctaccagcagctgctggatttgaagccgctgatccggacagaaggggagagggccttgtttgaattgaaccgggccgcgcttctgtacgacatgcgtcaattcagggaggccgcggacgtggtgcttgagattcgttcgctgaatcccgagttcgatgccaaatgtgccgtggtaaagacgaagattatggatgcgctttagaaaggaagcatatacgacatgttagagatagaagcaatatacagacagattggaattcggcagaatgttcttgcgtttggcgggcagattgagaaagaactgaaagagcgttttgaacagatcgatcagatcgcggagtataatcagttgaaagtcatacaggccatgcaggaaaaccgagtgagcgaggggtgctttaactacgccagcggatacggatacgacgaccaggggcgggatacattggaggaagtctatgccagcgtattccatacggaaagcgcgcttgtacgcccgcagatcgcatgcgggacccatgccttatccatcgcccttagcgcgaacctgcgtccgggggacgaactgctgtccccggcaggaaagccttatgacacgctggaagaagtaatcggcatccgtccgtcctgcggatcgctggcggaatacggggtgtcctaccgccaggtagaccttttagaggatgggacctttgattacgatcgcattcgaaaagccataggtcctaagaccaagctggtgaccattcagcgctcaaaaggttaccagaccaggcccagcttctccgtgaagcagatcggggaactgattgcctttgtaaaagagatcaacccagatatcgtctgcatggtcgacaactgctacggcgagttcgtggaggtcatcgaacccagcgacgttggggcggatatggtagtcggctccctgatcaagaatccgggcggcggcctggctccaatcggcggctatatcgctggacgcaaggatctgatcgatgcctgcggctaccgtctgacgtctcccggccttgggaaagaagtgggagcgtccctgggagtcatgcagtccttctaccagggcttattccttgcgccgactgttgtagccggggcattaaaaggggcgatatttgctgcaaatatctatgagaggcttggctacgcagtggttccaaatggaacagaaagccggcatgatattatccaggcagtggaatttggaacgccggaaggagtgatcgctttctgcaagggcatccaggcagctgccccggtagactcttatgtaacgccggagccatgggccatgccggggtatgacagcgacgtaatcatggcggcgggcgcattcgttcagggatcttctatagagttaagcgcggacggcccgatcaagcccccatacgccgtgtatttccagggcggccttacatggcctcatgccaagctgggcatcctgatgtctctggaatacctggtaagggatggaatcataacattgccatagaagaggagcaataaggagtagatatgaaacggattggaatcatcggaggaggggcctccggcatcgtagcagcgattgctgcggccagaagcgacggcgatgcccaggtctttattctggaacagaaagagagcatcggaaagaaaatacttgccactggaaatggacgctgcaacctgaccaacgaggcgatggatgcttcctgctaccatggcgaagatccggaatttgccaggaatgtcctggagcagttcgggtatggggagactttggaattctttgcttccctgggacttttcaccaaaagccggggcggctatatctatcctcgctcagatcaggcggcctccgttctggaactgctggaaatggaactacgcaggcagaaggtaaaggtatataccggagtacgcgtagaagccctgaaacgttccgccaaaggatttgccattcgtgccaatggccagaagttccttgcggaccgggtgatccttgcctgcggagggaaggcgtccaaaagcctgggttccgacgggagcggctatacgcttgccaagtctatgggccatacgctgtcccccgtggttcctgcattggtacagttaaaagtaaggaagcatccttttgccaaagccgccggagtacgtactgacgccaaggttacagcgattcagggccgccaggttctggcagaggatacgggagaaatgcagattaccgcctatggcatctcgggcatcccggtattccagatcagccgccacatcgccaaaggattgtatgaggggaaggaaatgaaggtaagggtagattttcttcctgagatggaggaagcccaggtacgcaaggcctttgacgcgcgtttggataaatgtccttatgccacatgccaggaattcctgacgggaatcttccccaaaaaattaatcccaagactgctggaactgtcccatatccgccaggactttccggtatccgaacttaagcccccacaatgggaggatttgatacgcgcctgcaagcagactctgcttacgatcgaggacaccaatggatttgacaatgcgcaggtctgtgcaggcggcgtacgtactggcgaagtatatccggatacgctggaatccaggtacgcagatggcttatatcttaccggcgaactcctggatgtggaggggatatgcggcggatacaacctgcagtgggcctgggctaccggatatctggcagggcgcgcggcggcaggaagatcctgacatctactggagtatcttaactatgaatgtcaacttctgacagatccggtcataaaaaagtgcttgttcaatttaaaattgtacgctatactttaagtcggatagaagaaaagaatatagaagacccggaccagagggagatttcttctgcgaagggtcttatttctttttggcagttcaaaaaaggagaatgatatctatgattcggatcaatcagttaaagttaaatatcaagcattcagaggcggatctcaaggagaagatcttaaaggttctccgtatcagcgaagattcgcttctttcttatgaaataaaaaaacagtccctggatgcgaggaggaagccggaacttttctatgtatatgccgtggacgtaaaggtgaagaatgtatcatccgtcaagaaaagagtgcgcaatcagaatgtgcagtttaaggacaagcccctgtcttaccagattcaggcggatggaaccgaagtcctgaatcaccgcccggttgtcatcggaaccgggccggcagggctcttctgcggctaccagctggcggtcttaggctaccggcctattctcctggagcgaggggcctgcgtagaagaacggatgcaggcggtagagcgattctgggctaccggagaactggatcagaattgcaacgtccagttcggggaagggggcgcaggaactttctccgacgggaagctcaataccctggttcatgattctaacggacgcagccagaaagttctggaactcttcgtggaatatggcgcgccaaaggagattctgtaccagcataagcctcacatcggtacggatgtgctctcccgtgtggtaaagaacatccgggaggccatcctttcctatggaggggaggtgcgcttcctcacccaggttacggacatcctgtcagaacctgccgggaagggccgccgccttaccgccctgcaggtctatgatcatgcagccgggaaggaagataccattaagacggatatcgccgtacttgccatagggcacagcgccagggataccttttccatgctgcttaaaaacgagatccctatggaagccaaatcctttgccgtaggcgttcggatggagcatccccaggctatgattgacgaattccagtatggaatgaaaaacgacggcaccctgcctccggcttcctataagctgacggagaatctggcatgcgggaggggcgtatataccttctgcatgtgcccaggaggctatgtggtcaatgcttcttccgagcccggtcgcctggcagtcaacggcatgagctaccatgaccgggacggattaaatgccaacagcgccgtgatcgtaaccgtgacgccacaggattatggcgggacgggcgtgctggcaggcatggagttccagcgcaggctggaggaagcggcttaccgtttaggtaagggcaggatccctgtacagctgtttgaagatttttgcaagaacaggccatccaaaggcccgggagacattcttccacaaatgaagggggcctatgcctggagcaacgtcagagagatattcccgccggaactatccctggctttggaagagggaatccggtcgtttgaccgtaagataaagggatattcccgccctgacgctctggtgtcaggagtggagagtcggacttcctccccggttcgcatcagtcgggatgaatcgatgcagagcacgcttttcggactctatccatgcggggaaggagcgggctatgcaggcggtattacatcagccgccatggatggactaaaaacggcagaagccatcgtcaaaaaataccaatctttcgacaaactaccgaaaggcttaagaaatttttaatgggataagtatatacactctttcctaaatatgataaaatgtattgagttttttagatagacaaaacgaggaggagtacatatgaagggaacagggagtaagaacgcctgggctttatttctgctgattttaacaggaatcgtccttggtggctttatcggcatgctggccgaaggggtaccggctcttagctggctggcctacggacagtccttcggactggatgagccaatcatcctgaatctgggacttcttgtagtcacgttcggcctgacgattaagataaccattgcaagtattattggcgtgattctttccattattatttatcgtttcttataagttctattatgagtgtcgtacgaatctaaagataagatgaatcagtcaaataccataaaagagatacccgagatggaacgcccatatgaaaaatgtgagcgcaaaggggctgccagtttaagcgatgtagagttgctggctgtgttgctgcgtacaggcactcgcggagaggatgtgctttccctggcaagaaggatcctctatcacgcaggagagccaggcatactgggcatacatcagtttagtatggaaagactcctgaagatcaaaggcattgggaaagtaaaggcaatccagatatcctgcatatcggaacttgccaagagactttccaaggccagctaccaggatcgattaagtttctcacatcccgctacgattgccagatattatatggaagacttaaggcatgaaaagcaggaagtgatgaagcttctgatgctgaactcgaaatcaagactcattggcgagacagatatatcaaagggaacggtaaatgcctccttgatcacgccaagggagctttttatagaagcattacaaaagaatgctgtatccatagtaatcatgcataatcaccccagtggtgatccgactcccagccgggaagatatgctgacgacaaagagaatccttgatgcaggcgcattgatcggaatcgaactgttagatcatatcatcattggcaataattgttatatcagcttccgggaggagggattgctgtagaaaggattatcacagatggcaagaaatatatacggattagatcttggctcttatgaaatcaaggtctacgataaaaagaaagatacgatctggaaagagaaagatgtaattgcgattgcagataagaaagagatttttgcggtgggggatgacgcttacgagatgtacgagaaggcgccatccaatatagaagtggtctttccaatgaaagagggcgtaatctcgcggtttaacaatatgcagtttctgcttcagaacctgctgaagaaggaccgccagtttgcccgtggatccgaatatgtaatcgcggttccaaccgatgtgacggaagtggagaagaaagccttttttgacctggtgatccactccacggcccgcgcaagagaagtgaatatcgtagaacgctccatcgcggatgcggtgggacttaacctggatgtcaagaatacgggcggcctgttcatcgccaacttcggcggagagacaacggaactgtcggtactggccggaggcggcatggtcatgaaccgcctgcttaagatcggaggagtctcctttgaccaggcagtcgtcaatctggtgcgtcatagccatgacttcctgatcgggcggctgacagccgaagttctgagaaagaatttcggaatattcaccagtgattccgagtccgtattaaccgtagcgggcagggatctgatcaccggcgtgccaatgcagaagccgatctccatcagcctggtgcgtgccgctatgaaggatcctctgctggaatgcgtgcgtgccatccattcccttttagacaggacgcctccggaggtccgtaaggcaattcatgagaacggcatctttctcaccggtggagttgctaatatggcaggccttgaaacctatatcgaggagatggttggaatcaagaccagaacggctctggatccggacatctgcgcggttaccggacttaaaaaaatcattatgtccaaagatttgagaaaacttgcatattcaatgttagatgaaaattataggtggatgagataatatgaaaaccaagaaccaatcttcccttccaagtaaatactggctgctgattctggctgtggtctgcgtgatcctgcttggaatcgagcgttttgcggacggtggcgggcctttaaggtttatcgccaactataccgtaattcccatgcagaaaggaatcagttatgtaggacggttcatgagcgacctatctgacaactttgagactctagaggaaatgaaaaaagagaataagaccctccagtccaaggtggatgaactgaccattgacaatacgcgactaagacaggagcagtacgaattggaccgcctgcgggaactgtataagctggatgagaactattcggattacaagaagattggcgcccatgtaatcgccaataacggaagcaactggtttacagattttaccatagataaaggcagcaaagacggcatcaaggtcaactgcaatgttcttgcgggcagcggacttgcaggcatcgtcacggaggtaggccctaattatgcccgcgtccgttctaccatcgatgatgccagcaatataagcgccatgattctgtccacatcagacacctgcgttgtcaggggtgatttgaaactaatggctgacggtaggatccgttttgaaaaactgccgaacaatgacaacaaggtggaagtcggggagcaggtagttacctcccatgtcagcgacagattccttcagggcctgtttatcggctatatcagcgaggtggaagtagattccaacaaccttacccgctccggctatatcacgcctgccgtagatttcagcaagcttcaggaagtcctggtcatcactacgacaaagcaggagatgctggatgccaaggacaaagacagcaaaggagagtagtccatgaaaagaaagatcataacctttattattatagtgatctgcttcttgctggaatgcaccatattccaccggctgtcctttgcgtccatcaagcccaacctattgattatcgtcacctcttcctttggcttcatgcgggggaagaaggaaggaatggccgtgggatttgtatccggccttctggtggacatattctggggcagcgccctgggcttttatatgctgctgtttgcggtgatcggatacatgaacggcttcttcagacgcttgttctatgatgatgatatcaagctgccgatcgcgcttatcggcgcaagcgaactgatctatgggctggtgacgtatttctgcctgtacatgctccaaggaaatttcgcttttaccaattgtctgacacatatcattctgccagaactggtatataccattctgataacattggttctgtatcagatcatattacacattaacaagaaactggaagcagaagaacaaaggagtgcaagcaaatttgtatagtttatgggaccggatcaaatccggaatatatgaagttgtaaaatcccgtatattcgtcgtcattatcgtgttctgcatcatgtccgccgttctgttgcagcggctgttctatctacagattgtaaaagggcaggattattttgacgattataagcttcagatccaaaagaccaaggaagtccagggaacccgcggcaagatctatgaccgcaatggcgtcctcctggcttacaatgaactggcctacgcggttacgattgaagacaacggagattatgacagcatcaagcagaaaaataaagaactgaataaggtcatctccactgtgattggtatggtggagtccaatggagacaccgtaatcaacgatttcggcattatcctggacaacaataacgagtatagctacattgcggagaatgacacccagaggctgagattcatagcggatgtatttggcaagaagaccatagatgaattgtcggacaagcagaagaacatctctgctgcgggtctcgtggactatctttgtaccgatgagctcaacggctatggaatcaaccagaagaagatggaaaaatcagaagtcctgaaattggtcaacgtccgttatgccatgtcgttaaacggattccagaaatacatcgcgaccactatcgcagaagacgtaagtgacgagacggtagcagatgtcatggagaatctggacacgcttcagggaatcaatattgaagaagaatctttgcgccgctatgcggacagcaaatgcttttccaatatcatcggctacactgggcagatttcccaggaagaatacgatgcgttgagcaaagaagagcaggaggagtactccctgattgacaccattggcaaatcagggctggaacagacgcttgacagttccctccaggggaaaaaaggggaggtcaagctgtacgtcaacagtgtgggcaaggtgatcgaaacggtcaaggggaaagaccccaaggctggaaatgatgtatacctgtccatcgatgccaacctccagaaggcggcataccatatcctggaacaggaactggcaggcatccttctcgcaaagattcaaaatacgctagattttgaccgaaatcaggtagatgacggaagcgacgttatcatcccaatcggggatgtttacaatacattcattaccaatgatatcctggatatgaatcattttggcgcggaggatgcaaagcctaccgagcaggaggtgaattccatctttactgcgcgcaaggaagaagtaaagaaccagctatcggatatcctaaatgatcccaatgcaggcgcatataaggatatgccaaaggagatacaggcatacctgacctacatcgtctccgatgtgctgaccggcaccaccggcgtgatcatgccggatgccattgacaccagcgacgccacctataaagcgtggaaggatgaagaatccatcaatatatatacttatctcaattatgcgatttccaagaactggattgatacatccctgttaaaagactatgtatcatccaagggaaaatattccgattctaacgaactttatcagggaatcgtatcgtatattatggattacatcgattcagacaacagtttcaataagctggtgtaccgctacatgatcaaatcaggagctatcaccggacgtcagatatgtctgatgctgtatgaacaggggatccttacctatgacgaggcccagtataacggcctgaattccgggagcattggcgcctatgactttttaaggggcaagattgagactctggagattacgcctggccagctggcgctggagccttgtaccggctcgctggtcatgacggatacgacaagcggcgaggtattggcctgcgtatcctatcccggatacgacaataacaggcttgccaataccatggattccaattattacagcaagctggtgaccgatcaggcccggccattctataataacgcgacgcaggaaaaaacggctccaggttctacctacaagcctatggtggcagtggcaggccttacagaaggcgtgattgataacaatacttaccttccatgccatggaatctacaagaaggtatcgccgaaccccaaatgctggatctatcccatggctcatggcaacctgaatgtggaaggcgccattgagaattcctgcaacagcttcttctatgaagtgggataccggatgagcctgaaagataacggcctgtcgcagattggctctgacaatgcagaaggaggcgcgaccaatgcctactattccagcgacctgggtaccgatactttgaagaaatacgcaacggaattcggcttaggagagacttcgggacttgagatcccggaatccgagccgcagatatccgataagtcctccgtaccttccgcaatcggacagggtacgaataactatactaccagccagcttgcgcggtatatcaccgcagtggctaacaagggcactgtttacaagctaagcctgattgataagattacgtccgtagatggcaagactgtcaaggattatgagccatccgttctaaataccatgaccgacgtggcaccgtccacctggaacgcagtccataacggaatgcgaaacgtggtgtcagtcgcccacagcaatctgtttaccaagctgaacgccagtgatgtcaaactgttcggcaagactggtacggcacagcaaagcgaaacgcatcccgaccatgcgctgttcgtaggattcgctcccagcgacagcccgcaggtggcatttgccataaggattgcgaatggatacagttcgacctatgccgcagaagtagggaacgacgtaatggaatactattatcagataacgccggaagaagagattcttaccggaacagccgcagatatcagtgcaggcgcgacagttggagattaataaaaaggagagagagcgacagaaaggatgagcgtatgtgaaagacccggtactcattaagagtaacaaatacggcatcaccatatactttgatccggacatgccctatgaagagttattgccggaggtgagagaaaagttcgagtcgtcagcacatttttttaatcatgctgacatggctgtcgaatttgaaggccgtactttcacagaagaggaagagcagcgtatggcagaagtcatacaggatgctgcgaagatacggatactatgcatcattgagaagaatacttatacggaacggctccacaagcggatgctggatgaaagccttgaaaccatccatgaaagagacggacagttctataaaggtacgctgagaggaagacagattctggaatctgaaaaaagcatcgttatcgtaggcgacgtagaagaaggcgccaaagtcatatccaaaggcaatgtcgtcgtgacgggaaccatctacggaaccgtagttgccggcgccgccggcgactgcgatgcagtcatagcagcacttcatatgaggcccacaaagcttcgtattggagataatgaagtaaaaccagttataggaggaagttattcatgggcgaagttatcgtaatcacatcaggaaaaggcggcgtgggcaagaccacgacaaccgcgaatataggagcagggttatccaaatttgataaaaaagtagtcgtgatcgacaccgatctgggccttcggaatctggacgtagtcatgggccttgaaaatctgatcgtctacaacctggtagatgtcattgaaggaacatgccggctaaaacaggccttgatccgcgacaaaagatatgagaacctttatctgctgccttctgcgcagacgaaggacaagacagcaatctctcccggacagatgaaaaaactgacgtcccagctaaaggacgaatttgactacatacttctggactgtccggcaggaatcgagcagggattccagaatgccattgcaggcgctgaccgcgccatcgtggtcacaaccccggaagtatcggcgatccgtgatgctgatcgcatcatcgggctgctggagagcaaccagcttaagaagatagacctgatcatcaaccggattcgcatggatatggtgaagcgaggcgatatgatgtcggtggacgacgtgacagagattctgtccgttcccctgatcggcgccctccccgatgatgagcaggtggtgatcggcaccaaccagggagagccagtggtagggcttgattcaaaagcaggaaaggcatatcttaatatctgcaaacgtattatgggaattgaggttccatttatagaactggaaaacaattccggattcttttccaaactttcacatttattcaagaaagattaggaggagtcaaggatgttaagaaagtcttctgtctcaatcgcaaagaaccggctgaaagcgctggtcacttcagaccgggttttctgcacgccggatgcctatgataatatatgcagggaactgtacgaatcgctttcgaagtacatggaacttacagaagaggattttcaggtagagattaaccgtacacaagtagtaataacattcgcaggagaagaaacgtgagattacccagatttacaaaaccatatcatttaaaagattataaattcaatctagtcgtcctggtcatcgcgctgtccatattaggcgtgcttgccgttggaagcgcaaaagaagtataccagtcaagacagattgtcggcatgattatagggattatcgcaatggtcatcgtatccttgatcgactatgtgtgggtattgaacttttactggatcatctatggattcgtcgtgctgatcctaggcgctgtattggtgatcggagataaagtcaatggagcaacacgctggattgatctgggattcactacctttcagccgtccgagcttgccaagatccttttgatcctgttctttgccaaatttatcatgatgcatgcggaggacatcaacgataaggtcacgctgatcaagtatgcgatactttcggcaattcctctggcgctgattatcgtggagccaaacctttccaccaccatatgcacggccctggtcatctgcctgatgatctatattggaggattaagctataagttcatcggcacggtcctattgattctggtgcctgtggcgatcattttcctaagtatcgtggtacagccggatcagaaacttctgaaggattatcagcagaagcgtatcctggcgttccttgagccggaaaaatatgaaagcgacgaagcataccagcagaagaattccgttatggccatcggctccggccagctgacaggaaagggcctcaataataatacgaccacttccgtaaagaacggcaatttcatctcagagcctcagacagacttcatctttgccatcgtcggagaagaacttggtttcgtaggaagctgtatagttgttgcgttattattattaattgtgatacaatgtattctagtgggcatacgatcgcaagacttagcagggaggatcatatgctgcggggtaggaggcctgatcggcttccaaagtttcatcaatattggcgtggcttcaaaactgcttccgaatacgggagttcctttaccttttgtaagttatggcctgacatctctggtcagcctgtacgttggtatcggatttgttttaaatgtcggattacagccgaaaaaatatcaataaggagttgaaaaacaatgaatattggcttgatagcacatgattccaagaagacgctgatgcagaacttctgtatcgcatacaggggaatcttaagcaagcatgaactgtacgccacgggtactaccggacggttgatagaagaggttacgaacctgaacattcacaaatatctggccggtcctttaggaggcaagcagcagctgggggcacagattgcccagaatgacattgatgccttgatcttcctgagggatccgaacaatccgaagcctcatgagccggatgtgaacgatgtaatacggctgtgcgacatgcacaatatacccatggccacgaatctggctaccgcggaactgatcatattagcaattgacagaggggatcttgactggcgtgaaatgtatcggtagatttggaaaatggattctgatggcttcatcggctgcattcctgctgaccggatgcgcccggataggacagcagtttaaggcacaggaagtggtaacggcctatgaagcagaacattacaataaaaacctgtacacgggcaaactctttgcctctgatctttgtgtagcgtctgaaaacgtagcgtaccagggtgcgcccgatcctgccggacttcatgcggcaggcttgtttgacgtagaggatgggatggtggattttgcatacaatctccacgacaggctctatccagccagcaccacgaagattatgaccgcgctggtagcccttaagaaggggaaccttacggatgtggtaagcgtacaggcagacgcggatgctgcaaactttgccgcggatgagaagacctgcgggatcaaggccggggaccagatgaccctgggcgatctgctgcatgggcttttgatggaatcaggcaacgatgctgccgtcgccattgccgactacataggcgggaattccgaacagttcgcacagatgatgaacgaggaagcccaggccttgatggccacaaaaactcattttttaaacagcaacggcctgcataatgagaatcattataccacggcctatgacctctacctgattttcaatgaatgtatcaagtacgacgagtttgtggatattattaatactgcggaatatacggcaaatattacaggcgctgacaaaacagtgcgtcaggcggcttggaagcagaccaatttctatgcgcttggggaagccgaacttccgcagagcgcgacgattattggcggaaaaacaggtaccacggaacttgccgggaactgcctgattcttctggagaaggatgcctccggcaggccgtacatatctatcgtcatgggagcagatacaaaatccctgctataccaggacatgacagcaatcatcaatgggatagggcagcaagaaccggcagccgcggatgcggctgatggggatgcaaagcaggatgagcctgcagccgcgagtgatgtagataatggaaatccataggatgaatagagtttaagaggggcatctcgctatgggatacccctcttgctatgaatgaccgttgacgctatgaattgtttccgattcttccatacagactaatcagatagagaccgcataagccaacgattgtatagataatgcgggatagccaggagagattgccaaagatgaaggctactagatcgaaccggaatatcccaactaaaagccagttgattgcacctataatcacgattgtcaaagcggtattatcaaaccatttcatgtgagttcctccttttttcatgctaatcttagtatgccgaaagaggattgaattatacacagagaaaggaatattttatcagatggacgaaaaattgccatattacccttattctgaatttttaaaaaataaatatggcgaaaaggtatacaaacttccggtaaatcttcccgtcagctgccccaaccggattgcgggaagcggctgcgccttttgcgcggaagcaggaaccggattcgaagccatggattgcatgacgcctgttacgcagcagttaaatgtcacaaaggagcgtattgaaaagaaatatcatgcacataagtttattgcatatttccagaattataccaatacattccttccggttgagaagtttgaagcctatatgcgtgaggcggccgcattgccatatgttgcggagattgccatctccacaaggccggactgcattacatcagagtatctggatgtgcttcaacgaattcaaggggagcatgacattggcattacgatcgaattgggccttcagacgaccaactgccatacgctggcgtccatcagccgcggccacacgctggcggaatttatcgatgccgtgcttgccataaggcaatatggcttcgagatctgtgcccatgtaatcttgaatctccccggagatgatatgctggatacgatagagacttcaaaggtcctatccgcgcttcggattccggttgtcaagattcattccctgtatattgcgaaaaacacacagttgtgcgatgactatgaaaatggtacaataactttatgctcaaaagaggaatacctggaacggctgatggccttcctggaatatctggatcccgcaactgccatcgagaggctctttagccgcattccagaaaaggatgccgtgttctgcaattgggggacgagctggtggaagcttagggacgagtttttaagccggatgaagaaagagggaagctttcagggcaggagattccaatatcttaacggagcagcgctaaagcagctagactgacaataaatagggggctttatttttggctagggacgaactgacgaacatacaagtttatcgaaaaaaatggaatataaatataggcattatcatcttcggcgtgatctttatctatctggtggtgaccgtattgatgtatctgaccaacaagcatgtatctgcctatgaagtcagggaaggctccatccttaaggatactgcctatacggggctgatcatccgggacgagacggtggtgaatgcagaggcagacggctatgtgaactactttgcgccggaaggcagcaaggtgggcgccaagaccagagtctatacgctgtctgacaagaagctggaatttgcggatgctacttccgaatcccaggaactgacttcggaagaacagtcttccatactgatgaagacccagtctttctgcgaaagttttaaagagcagcagttttcagacgtgtatacgcttaagaacagcgtctccaatatactggagagcaagtccagccaaagcaggcagtcccagctggatgggatggtcacggaaggcatggaagggctgcagatctactcggcggcttcagacggagtcatcgtgtattctaccgacggatatgaaaataccacgatcagcgatgtgacggaggatatgatcgccaagaaggactatcaggccaccggccttaagaacaatagccgggtaaaagcgggaagcccggtctataagctgatcaaagacaataactggacggctgttatcttgctggatgatgctgctgcccaggaaatggccgatatgaaaagcgtaaagatccgtttttccaaggataatgagaccgcagtggctggcttttccatctataatacgaaggatgccaaccttggatttttgacattcgacaattctatgatccgctatgcggaagaaagatatctggatatggagctgatactggaagatgagtcgggacttaagattcccaagtcttccgtggcggacaagaagttctatctggtaccagaaaactatcttacgcaggggggcaacagcaaggagaccggcgtcctgatcaataatggaaaagaggatgcccagtttaaaaatgtggaggtctattatagggataaagagaacaaaatggtctatctagaccccaacgtattcgacaagaatacttccttaagggagcctgacggatccgagacttatccgcttaagaagaccaagagcctgaaaggcgtatacaatattaacaaaggatatgccgtattcaagcagattcatatcctgtgcgaaagcgaagactactatatcgtggaggcaggcaatgattacggacttgctaattatgatcacattgcgctggacggaagcgaagttcatgaaaatgatgtggtattttaaaaaggagtgattttaaatgttaaaggaaaatctggaagcggtagaggcaaagattcaggcggcatgccacaaaagcggcagaagccgggacgaggttacgctgatcgccgtcagcaagacgaagcctgtggagacccttaaggaggcatatgatctgggcgtgcgtatctttggagaaaataaagtgcaggaattgtcagacaagcatgatgtccttccccaggatattcattggcatatgatcggccatttgcagcgcaataaggtaaaatatatcattgataaggtggatctgattcattccgtagattccctgcggctggcagagacgattgagaaagaggctgccaagcgcgatctggtggcaaatgtactgctggaggtcaacgtggctaaggaagagagtaaattcggccttatgccggaagaagttttcgaatttattgataaaattgcaggattttcccatattcaggtaaaaggactcatgacaattgctccttttgtagataatcctgaggaaaaccgcccgattttcgcacgtttgcgtaaattatctgttgacattgcagagaaaaacgttgataatatgactatgagtattctttccatgggtatgaccaatgactaccaggttgccatagaagagggcgcgacgatggtccgcgtgggaaccggaatttttggtgcgcgtgattatgctcaagtataaacggaagataggagaagttttaaaatgggagtattagataagtttttagatatcatgaagttaagtgatgatgacgattacgatgacgatgatttctttgacgacgactatgaagacgactatgaagaaaagcctaagaaaagtctcttccataaatctaaagattataaagattacgacgaagaggaggattacgaagacgactatgcgcctccggcaaagtccagatcttcccgatctaacaataaagtaaccccgatgcgccagcctgcgagaaggaacaacgtcagcatggaagtatgcgtaatcaagcctacatccgttgacgatgcccgcgagatcacggagacccttctgagcggaaggaccgtgatattgaatcttgaaggcttggatcttgaagtggcccagcgtattattgactttacgtcaggcgcgacatttgccatcagcggcaatctgcagaagatttctaattacatattcctggtaacgcctaccaacgtagatatttccggagacttgcaggatctgctgaacacttcttttgacgcatcctctatgcgttccaggttctaatcatgaacaaagaggaactactgcttcagaaacgcctggtcgaactttccaggatcgcatatacacgggagattgttacattctccgagtttctaaatctgaatgaattaaatattttacataccacgccaaagaatatgctcttatcccagtataagacttatggcggatatggcttatcagagcgtcagatggctgcatttctacctgatgctctttattatgattatcagtaccctattcagattatagagatttctccagttaacagaaaatttgcagaggagttaagccaccgcgattatctgggagcggtcatgaacctgggaattgaaagatgcaagctgggcgatattctgatcgaggatggaaaagcaatcctgtttgccaaggaggaattggcgggctatattatggaacatctgaccaggatccgacacactacggtaaggacctctattctgccggcatttgaggattcttatgagccgcgttatgaggaattaaaggggacggtagcatcggtgcggctggacaccgtgctttcgctggcctatcctctatccagaagcaaagttaccggcctcatcgaaggagcccgggtgtttgtaaatgggaaactggtgaccagcaatggataccgtctgaaagagggagacatcctgtctgtcaggaagatgggacggataggatataacggcatcctgtctgagaccaagaaaggccgttatatggtatccatccgcaaatatatctagaagagggagaatatgttgagagagaaaagcagaacgaatcattatattgcagctgtcataggcatagctgtgctggtattcctggatcagctaaccaaatgcctggcgattgacaggctgaagggacagtccccctttattatcatcaaggaagtattccagctggaatatctggagaacagaggcgcggcctttgggctgtttcagaatcagaagatctttttcttcctgagcgtcatcgtcatatgcgcggtcgtcttatggttctatcgcaaggtgcctatggagaagcgttttctgccgcttcggctgtgcgccgtatttatcgtggcgggggcctttggaaactgtattgacagaatccgtctgaattatgtagtcgactttttttacttcaagctgatagattttccaattttcaacatggcggatatctacgtcacggtatctgctgttgccttgatacttctggtattcatctattataaggaggaagaccttgaaagaatttttcaccgttgagaaccaggatggggaacgtattgaccgatatctttccgaggaattggaggatcgttccagatcgtacatccagaaattaatcaaagagaatcatgtgactgtgaaccagaagcctgtaaaagccaattacaggctttctttgggtgacagggtagagatagaccttccagaggcaaaagagccggatatcaagcctgaggacattcctttggacatcctctatgaagacaaggatatcatcattgtcaataagccgaagcagatggtcgtgcatccagcgcccgggcactatagccagacgctggtcaatgctctgatgtaccactgcggctttgaactgtccggcattaacggcaccatgcggccgggaatcgtacaccggatcgatatggacacgacgggatcgctggtggcctgcaaaaatgatatggcgcatcagagtctttccaagcagttaaaagaacactccatccggcgcatctatgtcgccatcgtccacgggaatatcaaggaagaagatggaaccgtaaatgctccgatcggcaggcatcccacggagcgcaagaagatgagcatccacagcaggaatggaagagaggccattacccattatcaggtgctggagcgctttggcaactatacctatatccaatgcgagctggagaccggacggacgcaccagatccgcgtgcatatggcaagcctgggccatccgcttttgggggatatggtatatgggccgaagaagtgccccttcccgcatcttcagggacagacgctgcatgccagaacgcttggaatcatccatccaaggaccggagaatatctggaagtaaatgccccgcttccggcttatttcatagaattgttagacaaactaaggaaatcctagcccaaaaccattagaaaattctatacatttcccttcaattgatatataataattgtataattatgaagaggagcgtgattggtatggctaaaacgaatacgatcatcactatcggcaggcagtttggaagtgccggccgggaaattggctatcaagtcgccaaggacctggatattaaattatatgacaaggagatgctggaccgggctgcgaaagagagcggcatatgccaggagttattcgagactcacgacgaaaaaccaaccaacagttttttatattctctggtaatggacacctattctctgggatattcctcaggaagctacacagatatgccgattaaccataaggtattcctggctcagttcgatgcgatcaaaaagatcgctgatgaaggtccctgcattctggtagggcgatgtgccgattatgctctggaagaatacgacaacgtgctgagcgtcttcatccatgcagatctggattcccgtatccgcaggattgcccgcatctatgacctgacagacgccaaggccaaagatatgattgtcaagaccgataagaagcgcgccagctattataactactacagcaataagaaatggggcgcggcggagagttatgacatctgcctggatagttccaaattgggcagggaaggtaccgcggaggccatcgagaggctgatcgagattaaagagcgcggaggcgacaagaaattatagaaacctacattttaagtaagaaagggatctctcattgctggattttattccagttatgagagatccctttctttttagctaattatcacccctggcctgaacctccggtattcttccttgattttttattgccgctctaatataatgaacttacatccgctataactgacagaacgtcaagtgaagaaagaggttttttatggaattaggaaaaataattgcgtttaatctaaagcgattgcgaatggaacggaacttaagccagggacagctggctaaagaggcggggatcagcaaggccatgctttcggatattgaaaaaggaggcagcaacccaaccatcaacacgatctggaagatagcaaatggccttaacgtgccctatacgaaattaatggatggcattgatgacgaggcgactgttgtgcagaggaaagataccatcgaacaatccggagagtccagcgcctatcgggtatactgctatttcacgacaacgcccacacgaaacttcgagttattttactgtgaattagatggacattcttcgaataaatccattggccattcccagaaatcgcaggagtatatctatgtcatgaatggggaactgatcctggatacgcaaaagggagaatatgtcttacaggaaggcgattctctcgcgtttgattcctccatcagccacacctacatcaacaggcaggatacgctgcttgcatttatcgtgatcaattattatccaaactagtatccggagttttattatcagcgtacatggggaatccgtggaggccatcccttgatgttgccgttcagtattgccgtgaacatccgctgcctggctccggcatgctcatcgtccagctgcttcaccagttcctttgcgtactggcgcttggtatacccgtcaattggacagcggctggtcactacgggcagatcatacttctgcttaaatccaatcacttctgcctcgtctacgaacatgatcgggcggattaccgtcagatccatgcgatccagataggtctttggagagaaggagtagaagcgtccttcaaatatcagggacagcagcatggtctcgatgatatcatccttgtggtgggcgtaggctactttgttgcagcccatctccttgaccgcctgattaagagcgcctttacgcatcttggcacacagagagcaggggttgctttctttacgctcatcaaacaggatatgggcgatatccgtctttacgatcttatagggaactcccagttcttcgcatagatgaacgaccggggtaaagtcgcattcgctgtagccaagatccaccgtaaccgcgcttaactcgaacttttttggatagaaccgcctaagcccatggagcgcgtacagaagcgtcagactgtcctttccacctgagattcctacggcgatatgatcgccttcgtctatcaggccatattcatctacggcctttctggtataactcaacaattgctgtaatttcatcctatgtccgtcctttccaacttcaatgtcagtccacatatagattacatgatacatgcctattttacaagaaaaaagagaagaatctaagcttcttcatttgaaattcatatctttctgttataatagcatcaatatgaataaaaagagggagaagtacttatgcgaagaatattattcctggaagatgagccaaccatcagggaagtattggcagaatatatgaagatgcagcgttatgaagtcacggaagcctgtgacggcgatgaagccgtcgctctgcttaagagccaaaattttgatctggcggtgctggatatcatcgtgcccaaaagaagcgggctggaagtccttgcctatattcggcaggagtatccggatatggctgtcatcatgctgacagccctggacgatgagcagacgcaggtaaaggcgttcaatgcctatgcggatgactatgtcatcaagccggtgtccccattgatcctgctaaaaagaatggaaaccatcttaagacgcaccacgcataacagaacttcgtcaggaattaaagatcagacggacagggcagagcaaggactttccatagaccaggatgcctatcaggcttattatgatggccaggctcttccgctgacgctaagcgagtacctgcttcttagcacgctttatcaggagcctcagcgggtctttacaagagagcagctgattcttcggatatttaatgaagaatatatcggaaacgacaggattattgatgcccacgttaagaacctaaggaaaaagctgccaatgaacctgattaagacggtgatcggcgtaggctatcagtatgccttgcctggcgaaaaggatgggaggaattaaaaatgcgcctgacaaagaagacgctgtgctacagtgtcctgatctctgcagtcctgatggccttcgtcgtagtctatttctgctttatgatgccatccctgtacgtggattatgccaaaaaggatgacctgaagtccgtagtagacgtacaaaaaggctatatgaaaaaccgcagctataaaggcctgacggtgaagaatcctaccggctccatgtccgtggagattcccctttccggagacacggtgtatatcgcgggaaagaacttccggattacggtacaggcggatgagcccgagttaaaggaatttctgcaggaaatccagcaggcattttcctcgggagacgatatggaagatattcagctgccggatatcgacaaagataggatgaaatctatcttcaatctcaataaagaatccctgaaagatcttccggtcaacatccatctggaagcggatgaagatttaaacgatgactcgttcaaggaaaaggcggtgaagacccacgttatctctgacaatatcatcgtatttgagggaggaatcattgatgatacgaatgaatacacttcctatattgcggcgggaagaacttcagacgcgctgatcctatccttccttccggtgatgaccccgcagatgaatgaaattactccggtggtattaagcagccttcctatgctgatggctgtggtattcctgatcgtgcttatcgcctcccgcatgttctccagaaagatcgtgattccggtcattcgccttgcacaatatgcggaagaagtgaagatggccggacatatggatattgagccgctatccgtcacttccaaagacgagattggagaactgggcgccaccttgaacgaattgtatgggcagctgcgcctccaatatcaggccctggagcagaagaaccaggccctggcccaggagaataagcgccaggaagtctttctgcgcgcatcttcccatcagcttaagactccggttacggcggccctgcttctggtagaaggcatgatgaatgaggtgggcaagtataaggatacccagaagtatcttccccaggtaaaacagcagttaaagattatgcagaagattgtagaggatattctgtatctgaaccactgtaccgagcatatggagaaggagtcctttgatctgaaggggctggcagatgagattgtcctgggttaccaggtacaggcctccacaaaaaacctgactttccgaatagagggagcatccgggcccgtctgcacggaccgggatatgctaaagaagattgtcgacaacctggtatccaatgccgtatcctacacgcctgccggcaacctgatccaggttacgctagaagagaagtgcctgaagatctttaaccatggagggcacatcgaagagtcgctgctccctgatatctacgagccatttgtcagcagcgacgtacagaagaaagggcgtgggctgggattatatatcctttcctactatgcccagatcctgggctgcgacgtaaagattgtcaacgagtccggcggcgtgctggctatacttaggattccctgatttgatttcatacagcctctacgccatattcatcggaaattcatatcatcatgctagaataacagcatcaaaggaaaaggaggcatatcacaatgctcgtaaccatacagaacttgcaggtgcaatatggaaaacagacggccttgcagatacaaaagcctattgccatcgactccggagagcggataggaatcatcggctccaacggcgcgggaaagactacgctggtccgcaccatcctgggactgacccattacagaggaaccatacggaccagcctaaggccggaacagatggcggcccatctgcagcagaatcattatgcttcaaccatgcccgtaaaggtcattatggaaactgttctcaatactgatattaagaaagatgggaaactaaaagaactgattgactattttgaattcggcccttgccttagaaagcgatattccgcgctttccggagggcagaagcagaggctgacgatcattctggtgatgatgcaggatgcgcctcttaccttctatgatgaagtgacttcggggctggactttgaaaccagacagcggctgatgggaaaattatctgcctggtataaggacaaaaaggaccatacgctatgtattgtatcccactattatgaggaactagaaatgctggctgataaactgctgattctggataaagggcaggtcgtggacttcggaagaacggatgaactgttccggaaatattgcggaaaatcgatcttcattgtagaccgcacgcaggaaaacgaacgtcttcttgcgtcgtttcccaaactggcttcccctgcgcatctgatcgccctttcctgcgccaaagaggagacagagcacaggcttgcagaacttctcatcaacgcgaatgtgaattttaagcggagctgcagcgatatcgagattatgtctgccaatgccaaactggcatatgaaggcaagaaggaggcttgtgtatcatgaacaataagaaaagcacaaaaaaattggtagcctatgaaatctataatatcattgggaatcctttttcttcctttttcggaatcgtatttccgattctcatgctgctgatcataaccaatgcaatcaaaggagatgtaccaaaaagcatggctgcgcaggccaatacgtccatctttatcaccatgtccctgataaccccgatggccatcatctttctcggctatgccgctacctattcgcaggaactggagaatgatattccgcttcgcatggggttattcggcttctcagagcgtttcatgatgcgggcaaaaatcattgcccaggtcatcgttctgactgccgcgcttgcaatctataccttggtgtcctacacggcgctggatctggaaatccccagtttttccggggctgccaccctggtcatctgcctctacctgatgggcgtcattttcttcatcctggctcacggactggctaatatctttcggaagttcgggcctacttatgcactggcaatgatcctatactttggaatcatggtcctgtgcgggatgatgggaatacagacggaccagcttcccggattcctccagaagattgccgcacttcttcccatgtcttacgtgagcagcgactttgttgatctgtggcagggcggaagctataactttatgcccttgatacaatccttcctgtttatgggggccataagcggaatcctccttctgtatgcgaactataagaatcgcaggaccgtgggataacagggtcagctttctcttaacttcacggcagacgctgccttgcggcgtctgtcttcatcaatggccgcataatgcttcttcgtcgtatttacatccttatgtcccagaacatcagccacaagatagatgtctccggtctctttataaagagatgtgccataggtgcttcgaagcttgtggggcgtgatcttttttgtcggcgtcacctgccgggcatacttcttaaccatattttccaccgcctgaatacccatccgtctcttctgcgtagagagaaacagggcattttcgtggccggagaggggagtggcagcctttctgtctccctcaatataatgcttcaaagccttttctacttcttccccaaaatatacaaccatttggttgccgcccttgcgcgtaaccgtaatcccattattcttaaaatctacatctgtaaggtcgaggccgacgcattcggagacacggattcccgtgccaagaagcagagtcagtatcgcaagatcacggtccttcgtcttcttataatagttcaatgcctgtccggacagttcgtttccgcagttctctacaaaatccagaagcaaggcgacctcatccgcatccagacggataatcgccttatcatgaagttttggcatatccaccagcaaagtcgggttcctggagatagcctgacgcttgaaataatagttatagaaacttctaagcgccgacatcttgcgggaaaggcctttctccccattggtcaccagttcgtcgtcacgcttgtagaccttcaggtattccatatattcctcaatatccaccggctccagccgttcaaggtcacctaatgtaaactgatctatggaataattcttatatgtaggattattctccataagaaaatgaaaaaagacccggatatcataggcataattaatccgcgtctttgcggatgactttggctcaatggcccggaagaaatctttggcaaacggcggcagcgtctttaagacttcccttagccttattgtctgttccacctgtacttgttcatgatatgactttgattcagccatgaggaaacctccttattgttatttataccttacaattaatcatattatagcatatcccatttcctccgtctatatcttttggaaaaatcggtatttgtcgtatagatgtacttctatcaacagatatgatcttatggagccttgcctaatcaaaaggcaagcgtccgacagcaaatgaataactccatcgctgccggacgccgcaaattgggtgagtataatatatataagatgattaactcctatataccgtaataaataaacaaactatacagacggcatgcaaagcgattacctgaacgccgtatcatagtatgcgactgtaagatactggctttcctgaatgccatcggatgtaagcccgttaatatctttcagttcgtcgatgtaagcatagatcgaatcatagtcttcattcatatattcctttgcgatatcccataaggtatcgccggatgcaatctcaatactcttataatacttatgtctgaccggagactccgtggaattgccatgggcgtctacaaatccattgcttaaaataacgcttaaggccaatacaagcgcacagcccgcaaaacctaatatcaacttcttcataaatacttgtctctgtctttttcttgccacatgtaatctgctggtctccatagtatcctctcctccttaattatcccttatcccctcgtgtaaatacatttgttcgtgaacatctgttctgtgctttgaattatacaacccgaacgcacgtttgtcaatacttgaagaaaaaatattcgaacatattttctaaacatttgtttgctttttataatctgctatgataaaatataaccaaataattacaaaacgcatgatacaggcaatatataaggaggtttctatggctcaaggtaagattagtccgaagcagcaggaaatattagaatacataaaatcacagatactggaaagaggctttccgcctgcggtgcgtgatatttgcgaggctgtgcatctcaagtccacttccagcgtccactcccacctggagacgctggagaagaatggctacatacgcagggatccgacgaagccaagagcgatagagatactggatgaatcttttaactttacccgcagggagatggtcaacgtgccaatggtaggcagggttgccgcaggcgagccgctgcttgccgagcaaaacgtcgagaactacttcccgattcccatggaattcatgcctaataaccagacgtttatgctgcgtgtcaagggcgacagcatgattaatataggcatttttgacggagatcttgttcttgtggagcaaagacagaccgcccgcaacggcgaggtgattgtcgctcttgttgaggacggcgcaacggtgaagcgctttttcaaagaagaaggcgtctttcgcctacagcccgagaatgatgccttggatccaattatcgtaaaagaggttcagatactcggcaaagtgattggagtcttccgtttcctttcataatctacaacattatttgttcctaataaaataataaagaaagcccatagtccggcagttacagatcaacgatatttagagatctgtaatgccagattaagggctttctctattacaggcagcgatatttggattactatcgcaatctgttgtcttttattgttaatcgctttgagaccggatagtaaatttctgttatcagactatcctcctgtgcttgcgatggatttgccacatacacttcaaaaaccgcgctgctgcttacatatccttccttttccgcccattccctctgtctggtatatacggaagacagttccgaataggagccatacaaagttgttttcaggcaaagtcccgggcaaaagtctcttgttccggcggcatgctcttttacaggaacggcaaattccatatcaaggcctgccggactgaattcggcactgtgaaatagcgccataggcggagcggctgtcgtcaggcccaagtcctcgattttctcaaagatccgtccaaaacaattggcgtattcttcctcgaactcacattcacggacattctttcgaatggatacaagatacatcatgggcacttcgaccaggcttacatcaatattttccatataagacataatggatcttccctgttccaaggttaagatatccttattcaggcggtcttgagtatctcttagttcctgtaccatcttcttaagttccctttttttcctgatcaattccacataaagtttttcatcctgcggcttctttgcgtccagaatcgccctaatctcttctaaagagaaattataggacttcagccggttgataaaaagcatcctttttaactgttcgatcgagtagtacctgtacccgttctcaggattgatctcgtccggcagaatcagtccgatttctgcataatagcgaagcgtcttggttgacacctgacagatgtttgaaaactcgccgatagataacattgcttttcctctccggttcttttcttatcagtctataaatcttttatgtcgccgaatcgtcttccgtcgctccaaatgcgctccagattataaaattctctgttttccctgtcaaatacatggatgataatatcgccataatccagaagcacccaagagccgccatttcgtccttctccctgcttctggacaaacccggccttgtgcatcttttcctccacgttgtcaaccagggctcttacctggctgtcgctattcccattggatataacaaaataatctgcaagtaccgagatatgcgagatatcaatgacacaggtgtcttctccttttttatcttccagcgcctcaaatgcgacgcgtgccatttcctttgcttgttccatgctattcctccttctgatctaatttctctttataatattgatatgatttctctgtcatagggtcaatcgggatgttcctgctgtcaagatataccagcgaatcctttaatatacggtacaggcaggcatcgatatcatgaaaagccagtttccgtacttccgccatatttggaagttcttccctgccaggctcgatataatcggcgatataaataatcttctccagcagcgacatgtgcggccttccggtagtgtggctggcaatggcgttcacaatctccttgtcgtcaacatggtacttctttgccgccaggaaagcccccagtttcgcgtgcagcaggctgggattggccttctccacttcggaaacgctcagatgatatcggccgcagagcttgatcttgttctcgccggatatacattttgcgcagtcatggagcagtcctgccatcaacgccttatcaatgtccgcgtcgtagcgcattgccatggacgcggcagtatacatgacgcccagggtatgctcataacgctctttgtccagttccgccatcagcttacggcgtattctggttatcttttgattcatatgctgccattcctctcatacagatgatttctgataatatagtcttccacgctggatggaacataggctgcgatcgacttgccgcttttaatctctcttcttagctcgctcgacgatacgctcatcaaaggcgtcgccaatagccggatatgggcatcgtactttcgcgtcagatactgaatctgctcttccatctcagccctggtattgatctcgtcacggtaggtggccagtacggtacaggttggaaataaccgttccggatgcgcccaagtctcgatggcaaacagcgagtccgcgccgatgataaaataaaactcatcctccggatatatctgattaaaaaattccaacgtactgtagctataagatacttcctcccggcatgcctcatacaattccagccggaattcttcctttccgccaattgccagtctcaccatctcgatccggtcatctacgtcggattcaattgtagttctgtctttgtggggaggatgcccattgggcatgaaccatatctgatccagatggaatgtttcatatgcagcctgtcccagcataagatgcccattatggatcggatcaaacgtccctcccatgattccaatcttcataattatctgcctcgctctgccacatgaagcctccgcaatgctgagggatattaaggcagctgtatcttcttattcttatcttttccttctttatataagacaatcttctttccgatcacctgcacgacttgggatttggtgcgttccgccatcatatccgccagttcgcggggatcatcggcacagttcttcagcacgctgatcttgatcagttcccgtgcctgaagcgcttccgcaaccgctttcgtaagttccggcgtcatgctgttcttcccaatctggaagatcgggtccattgtcatggcaaggctttttaggtatgctctttgctttgtcgtcatcgtctgtcattctcctgttctatttcactatttataataatcaaactgcagcccgtacatccgcaccgtgtcgccttcctggatgcctgcggcctccagttcatccaggattccggtatcctttaagaacttctggaagaaggcaaagcctttctccgagtccaggttggtatagcccagcatcttttcgatcttcgggccttccaccacatagatatcatcttccttttcgacggtatatgggaggttctcgtggatcagttcttcttccgggaaatattccggctcgaagatcactggcgcctgatccagctcgctcagcctgtcagatacatagtagagaagttccttgattcccgctccggtaacgccggatatcgggaagacacggattcccttaggttcgaattcatctttcagcctctggattggatcttccccctccgggtatatgacatccaccttgttggctgcgatcacctgcggccgtttggcgatatccgggttataggcctctaattccgcgttgatcttatagatatcatcaaccgggtcccggccttccgtaccagcggcatctactacatggatcatcaatttggtgcgctcgatatggcgcaggaattcatggcccaggccgactccttcggatgcgccttcaatcagccctgggatatccgccatcacgaatcctctgccatcaggcaagtctacaacgccaagatttggattcagcgtggtaaaatgatagttggcaatcttcggatccgcattcgtcaccctggatagaagcgtggactttcctacattgggaaatcccacaaggcccacatccgcgatcactttcaattccagattcacccacaattcctgggatggctgtccgggctgggcatatttgggaatctgcatggtagacgttgcgaaatgctggtttcccaggcctcctcttccgccttttaagatcacctgccgacggttgtctccggacatatcggcaattactttgccagattccgattccttgatgacggttccttccggcaccttcagcacgatatcttccgcatccttgccgtggcatctgcgctttccgccttgctctccgtcttttgcggcatatttcttcctgtgccggtaatcctgcagagtattcagcccctcatccacttcaaagatgacatcgccgcctcttccgccatcgccgccgtcaggcccgccgtttggcacatagagttcccggcggaaactgacgtgtccgtcaccgccttttcctgattttatgaatatctttgctctgtctgcaaacatataatgttcctctttctttttttgcttattttccccaatatcctgtatattatatcataaggaacggctatttgccatccccatcctgaccgctaaaaaaagagtactgccttataaccagaaccagttatctgcagcactcttcttcgtagtctgttattatttagcaaccggatagatagaaacctgtttcttatctcttccttttctctcaaatcttacaacgccatcaaccagcgcgaataatgtatcgtctccgccgcggccaacattgattcctggatgaatctttgttccacgctgtctgtagaggatgttgccagcttttacaaactgtccatccgctctcttagcgcccagtctcttagattcagagtctctgccgttctttgtagaaccaacaccttttttatgagcgaaaaactgaaggtttaatttcatcatggttgttacacctcctcgaatgttaaatcaatatattctgcatagttctcatcatccgccatttctctcagaccaagaatcatagtctttaacagcagcgctgcctccttggagggcgcgccattgacatggaaggaaacaatcccttcctcctcgtcggaaagtaccgacacctcgtcatccgtatatagctcaatggcattcatcgtgttaatgaccagcacggaaacggctgcgcatacgatatcctgtcccatcttggcatattcggcatgtcctttggtctgaaagcctatgcattctttacggtcattttcataaatggttacatgaatcatggattatctccaaattaagcattgattttgtcaatttttactgcagtatactgctgtctgtgaccgtttttcttatggtatccagtttttctcttatacttgtaaacaatgactttctttgcttttccgttttccactacagaagcctctacggttgctccttcaacggttggatttccaacttttaatccgttatcgcttactgcaagtacttggtcaaatgtataagtctctccggcttctacaccaagtttttctactttaatgatatcgccttcggctactttgtactgtttaccacctgttgctataatcgcgtacatatggcacctcctattatcattactcgccaattacggtgtccctgcgggaactttaagacctcattgtgcggcatactggtatataatatcacaggaattggcaaaaatcaagtattcttgtgaaaatttacctgcaaaagtatcagggccgataccacgcagatgatgccgattatgttgtacgcatccagcgtctcatgatacagcgccacgccaaacaagctggctgccaccacttcgaatgaagcaatgatggaggccttgctgctctccatatacttaagcccaatagaatagctgacatagggaagcgccagcgtcactacgcttccaatgacaaccagaggcatcttggaaggatttgccgcgatacgctgtaccatagatgccggctggcagatgatcagcgttccgacagaggcaaagatgaacgtatatacggttacggtaagagaatcgtattttcctaccagcacttttccgaaaatgctgtacagggaatagccgaatccggcgcaaaggccgatcagcagcgtaaccgccccgctgcttcctgcattggctccagacagtcccactaccagaacgcatccggcaaaagacaatagaagggccacaaccttctgaagcgtcagtttttccttgaaaaaaagaatcgacatgatcatgacaaagaacggcgccgtataaagaaggaccactgccacagacagggacgccctctggaccgtctccgcataagccaggttattgatgaacaggcttcccagccctgttcctaagaaccatttcaaatcctgcttctcaatcttcagtttccgatggtcggtaatcagaagaaacaatatcaaaacagcagcggccgagcaaatgcggactgctgctgtctgtctcgtagtaaatccaatgtctgccacatatcttgtaacaattcccatcgagccccataagactgaggccatcaatacgaataacggggctaattttttcataggcattccctttcgctaaatcgctaataaactgcaggcatttttgtaaaatatctgatccttttcttcctctgtaagaggcatgccggacagaagttctatgaactctttctgccctgcccatggggagtcggtggcaaataagatcttgtcagcgccatgggtccggacgatccggacgaactgctcatccggtatcttgcccagtaccacgcccgtatcgaagtagacgtcttggcctaccagatactcttccacgtcatcccacatctcattgcccccaagatgcgcaagtaccatattctcgggcgctacctcgcggattaattccagcgccatctgaggcgtgcagtgaacgtcctccgggcactttgggtcccgtccggcatgcacgacggtgatcagccctagttctgaggcgtaggacaccagcctcttgtaacggatatcattgaaatacatttcctgatagtccggatgcagcttgatgcctttcatcccaaggcttttaatctcctgcaattcctgcttgtagttttcgctttccggatggatgccgccaaaagagatcacaggaccctcaagataactggatgcaaaccggttgatggatggaatctgggacaccttggtaacagccggcaatgccacggagatgtcaactcccgccctttcgccggacgccttcagtccttcgtatgtgccatctgtatagggagttaccttgcagaccccttccagaaagtctaaggttccttttgcaattttatccggaaacatatgtgtatgaaaatctattatcataattatttgtcacattccttcattttatcagagtaatagccgatgatatcacgccgcgtgatgatgccgataaagtgttcctgatcatcaaccaccggaacgaaattctgttccatcgccttaccgatcaggtcttccatattcgattcagcggttacgcattgatagtccaaccggcgttcaatcttcataatgctaatatcctccgcatctttaatgctcagaatattcagcttcttcaatgaccacagaacgtcgccttctgtaatcgagccaacgtatttcccctcccgattcaagatcggcaccgaagaatacttgtggtattccataatctccaaagcctggcgcagcgtatggtaatcatagatgtatgccagctcgcttttcggcttcaagaaaaataagatattcattttagacctccccaagtctttatatcattgtttttacgaatatatcgtagattgcattgacagcggtttcaaaatcatggttccttaccccgataatgatattaagctcgctggagccctggtcaatcatcttgacattgacgttggcatgcgccagagcggaaaagatccttccagacgttccccgggtcgcgcgcattcctcttcccaccacggcgaccagagccaggtctgattccagttccaggaaatccggctccacagccctgtgaattccggcgattaccttctgctctttctcctcgaactcatcctgatggacgaagatcgtcatcgtatcgatcccggaaggcatatgctcgatggaaatgtcattttcctcaaagacttccaacacctttttacagaatcccacctctgagttcatcatggctttttccaccgtaatggacgcaaaatccttcttaccggcaattcccgtaataacaaaccgaggctttctgcaagttccctccacgatcaaggtccctttatcctccggtgaattggtattgcggatattaatcggaattccttctttgcgtaccgggaagatggcatcttcatgcagcaccgtcgcgcccatgtaggataattcccttaattccctgtatgtaatgacgtcgatagatttgggctttcttacgatccttggatccgcgatcaagaacccggacacatccgtccagttctcgtacagatcggcatggacagcctttgagacaatggatcccgtaatgtcggagccccctctggaaaatgtcttgatctttcctcctggcatggagccatagaatcctggtataacggcccgctccgtcttcgccagccttttggacaataacttgtctgtcttctccgcgtcaaaattgccggcggcgtcaaacaggatgacttccgcggcatcaataaattcgtaccccagataggctgccatgattatgccatttaagtattctcctctggacgccgcatagtctcttccgatcttcttgctgaagttctcgcggatcgtccggaactcatcatccaggctaagcgtaagccccaggccgcttataatctcttcataccgtttctttatctcagcaagcaggccctcgaaattctcctcgcactcgtcctcttccaggagtgcctgcccatagcagctatacagcagatccgttacctttgtatcgtccggcgtccgttttccgggtgcagaaggaatcacatattttcttgcctcatccttcttaataatcttgccaactttcttaaactgctctgcacttgctaatgaacttccaccaaactttacaactatcttcatctcttttgtattcctccaaactgcttaatcctatgacttcaataaatgacttctattatattacatcatttttccatcatctgcaatggaatatctttatgaaatacaattcccttaatcccaagcctctgtgcggtttctacattttcagggcggtcatcatagaacacggcctctgccggatcgatggaatatctttttagaagaaggcggtatatctgctcatctggcttaatgcacttttctttccaggagaatatgccgccgtcgaacgtatccagaaacttcaatttctcatatgcctgccgatgaagttcataggagaaattggaaaggtagtaaatcttatatccttggtcccgaaaatagcgaatccacgcttccgtataggataatggccggatggttcccccaaatccggcgaatacctcccggatctgcgcttcgcaggagggttcattctcaataaagagctgcagccactcttgcgtggatacgattccacggtcgccttccacccagtcttcatttcgaaataccgcatctgctaccttttcccggatatcctcctcgtatccaaaactatccagatacgtcttccagtcatagtcaaccaatacttttccgatatcaaaaattaccgtattcatgcccaaccctttcttctgcttcttttcgcttcaatcatccgtccgtatcacatcagcgaattcggcatttgctgccttttgcaagtcaaatggcgataatttcaactgcatgccaagccgccctccgctaatatggatctgttccagtttctttgcgctttcctggattacggtaggaaactgcttcttcattccgattgccgtgcatccccctctgatgtagcccgtcacttttgtcagatccttaagatgcagcatctccagagatttttccttcaccgttctggctgccttcttaaagtctatctccgcctctatgggaatgacgaatacatagtatccgccactttttccaatggttaccagcgtcttgtaaaccagttcatggggatagcccagcttatccgccacctggactccgtccgtaaattcatcgcattcgtaagtcgtatactcataggaaatcttcagccggtccaagatgcgcatggcattggtctttacttccttcttgctcataatcattcctcctgtcgcatgtgcatgccgcgcaatgttagaataagcttaactgctcgtatgcataaggctgcctgtagctgtggatgatatctttcatctggtaaagaatatgatgcttctcgcattcttctttcaaaacgttccacaaactcttggccttcgggcttctgcattcataataagagccatatcttttctgatacttctccacatatccctgtccggggaacagttcattcagcttgccgtaataccagtcccgctggttgcctcgaagcgtcactccgaaagccgggtagataaacctggctccggcatccgccgccatttggacaatctggcggatattctccggggaatcctccagataaggcagtaccggcatcagtagtatccctgcatagattccggcatccgacagtctccggatcatctggaagcgttccgaggatgggcctacgccaggctcgatcttggcggcaagcgcatcgtcgctggtggttatggtcaccttgcacagcaccggggaatgttccttgatatcggatagaacgtctatatcccgcgtcagcagactgctcttcgtggcgatggcaatgccgaattcaaacgcatcgcacagttccaaggcatgccgggtaagaagcagttccttttcataaggattgtaaggatcactcatggctcccgtggccacgactcctctctttaccttgcggcgcagatcgtcccggatgatccgaagcgcgtcctccttagccatgaccttgtcaaattcctggatgccatagcattcggagcggctgtcgcagtagatacagccatggcagcagcccttatagatattcatattataatcggcgccaaaccattccccgggctttttcatcctcgtcacgatggtcttggcgggaatatattcgatcacaggcttatttcctttcccaatgcttctaaggttacgtagccagacggcgttccatcctgtctggcatatacctccaggcgatgaaaatgaagcggcacattctgaggctcttctccacaatacttcagaaatgcgtccatcaccagatccggctttaagttctgctcgcttccggtcgcaaggaacagatgccatccatccttgcatgcctccatattatagatcatcggcttgatatccacttctttctcgctgcgttttgtcttcttcatcaccacgatttcaggaagacccataaatgcttccgtcttttcgatccagcattccgggatgtcttctgttatctcagatgtcctggaagacgcaagcagcgtcaccttataatcagcggcggcaacgatcgtcatgccgcttgccttcttctcatccggaatctcccggaagcttacgacctccacgccttccaccatggccttattcagccgttctactgcctcggcagaggcgatcggcgcttttaattccacatccatatattcgccgtcgctggtaagaccaacgcccaggggctgggcaaaggacataatcatatgagggctgtaccctccgctgagtgcgatgggaatctgggcccttcgcattgccttctggaaaaaacgcatcatatccaggtgtccgatgaatttcatgactccatatttccgaaatttaattcttgctttcaatgcagacacctcctttatactttgcggctccgcacccggaacactgcatcctgcagttgggcgtcacctctcctgccagtgcgcgctcccattccttgcggaggaaggccttggtaaccccgatgtcaataaagtcccaggggaatatttccgccgcgtctctctgccggcagttataaaactcaatatcaatgcccgtgttttcaaaggctttcatccacttattataacaaaacgtctcgctccaggcatcgtacagacatccctggcggtaggcctcctcaatgacctgcccgatcttccggtcgccgcgggccagaaccccttccaataccgtagtctccgcgtcatgccagttatatttcaaactcttgcggttgagctgctcctggaactcgtgctttacgatggcggctctggcaatatactctttattgctgtacatccttgcccactggaatggagtgaatggcttggggataaaaaaggaggtgcttgtggtgatctggcattttccgtttctttcctccttggggatctcgtaatatctccgggcgatcttatccgccagccttgggatctctttcatatcctcttctgtctccgtaggcaggccgagcatgaaataaagttttaccttattccatcctccttcaaatgcctgtccggccccctccagtatcacctcttctgtcagccccttgttgatcacgtcccgcaggcgctgggagcctgcctccggcgcaaatgtcaggctgcttttgcggacatcctgaaccttgctcatgacatccagagaaaaggcatcgatccgaagggacggcagggaaatattgattccttcctccttaaacgcttcaatcagataggtgaccaactcctttaactggctgtaatcgctggaactcaaggaacttaaggatatctcctcgtggcctgtattcttcagcatctcgtaggcatattccttcagcacctctacgtccctctcccgggttgggcgatacagcatgcctgcctggcagaaacgacagccgcggatgcatccccgctggatttccagtaccacccgatcctgcgtcgccttgataaatggaaccaccggggctttgggataataggtattggtcacatccgttaccatctgtttctgaatcgtggccgaggcatgggaattattcggagtgaaggaagcaatcgtcccatcctccttatacgccacgtcatagaaggctggaacatagattccttcgatttcagccgctttttctaagtagtcctttctggtaccactatttttcttattctctttataagcatccaggagctgatcatagaccgtctccccttctcccatatagaacaggtcaaaaaattcggccagcggttccgggttataagtgcatggaccgccccctatgacgatcggatctgactcatcccggtctgatgccctccagggaatctggcttaagtccaggatctgcagaatgttcgtatagcacatctcatactggatcgtaatgcccaggaaatcaaaatccttgatgggatcctgtgattccagcgcaaatagaggaatcttctgctccctcattatcgcgtccagatctgtccacggagaatagacccgctcgcaccacacatcatcccgccggttaaacatgtcatatagtatctggatacccagatgggacatgccaatttcatagacgtccggaaagcacatggcaaaccggatgtccaccttatccttgtctttcatcaccgagtttacctcgttcccgatataccgggcaggcttctcgatttttaataatatttcatcacttaatgctaatcttctcatgttttcatcctttatactttatgcatgttacataacgcttttattatatcatcctatggtagaacttcaagcaaataattttcaatggaaagaaaggagagccccacgcggaaggctctcctttgacagtttgcggctttattgagcattttcaagtacgcttctgtctattgccttgttctgatgcgccacgatcgtcgtgcacacagcatctccagtaatattgaccgccgtcctggtcatatccagaatacggtcaatgcccatgatcagcccgatcgcttctaccggaaggcctacagagttgaataccatggtcagggttacaagtcctacgctgggaacgcctgcggttccgatggatgccagcgttgcggttccgatgaccgtaatatagtccgtcatggtaagatggatgccgaatgcctgggccgcgaacactaccgctacgccctgcatgatggcagtaccgtccatattgatggtcgccccaagcggaatcgtgaaggatgagatcttcttggatacgcccatcttttttgccagcgtgtcaatggacagcggaatggtagcattggacgtggctgtggaaaacgcgaacgccatcaccgggaagaaattcttaatgaatttgatcggattcagccccgtaaatactttaagcagtcccagatatacgatgaggcattggatcgccagagccagcagcaccccgatcatatactttccaagaggcaggaacgcgctaaagccaatattggcaaatgtcctggaaatcaggcagaatacgccgatcggagccaggctcatgaccatcatggtcatctccatcatgatatcattgaattggccgaaaaagttgctgaccgtctctgcccgatcgcccagtttggccaatatcacgccgatgatcagcgcaaagacgatgatctgcagcatgctgccgctggccagagagttgaccgggttgtccgggatgatgttcagcagggtatcggtaagcgatgtagcctccatctgcgccacatcggcagcgttcgtcttgatcgcgctcatatcaagcccgactccgggatcaataatatttcccaccgtcagagccacggtaatggcgagggctgttgtaaaaagatagaagatcagcgtcctcacccctaccgtgcccagttttttcgtatccccgatggccatgcttccacacaccagagagcagaacaccagcggtaccaccagcatcttcatcagccggatgaacccttgtccaattacatataagattccttctacgacaatatcatctctgacatgcccggaaggtaccagatagcataggataatcccgaatattgcacctgcgatcagagcgatgaaaatttttgtcgttagtccaatcttcttttcttttgccgtctttcccattctagccctcctttctttccttcatatattcttccagtgaacgcttccattccggcatctcgtacacatcgatgatccgcaggatgaagttgtcaagcaccgcgtaggcaggcctttcggaagatagatccgattcgctggtcggcactgccttaaggctgccttcctttccggaaaatctcaggatctcctgggcgaattcatagcggctgcacacacccttgcaggtggcgtggtaagtgccatactcattggtccggatcagatacaggataatttttgccagatcctttgcgctggtcggcgagccaaactggtcggatgccactgcaagcgtccttcctgcctccgctgcatcaagtacttttgtgacgaaattattccctcgtccatagacccagttgctcctgatgatgaagtgcttatgggtaaactcctttacatagttctccccggctcttttagagcggccgtacactgtccttggattggtatcgtcaaactcgctgtagggagtcttgctcatcccgtcaaatacgtcgtcggtagacagctggaccatcttagcccctactttgcgcgccacgatgcttaagttgcgcgcgcccagcgcattgacacggtaagccagttccggctccctctcgcatacttccgtgtccgtgaccgccgcacagttaataataacatccggacggttgatctcgccaaaattcagcacctcgtccgtttctgttatatccagttcgtccttgtccgtgttgaacacttctacttctaatggattcaggacttcattaatcgcagttcctatctgtccggaggaaccgactatccagattttgatcattctaacaccctccttggcatagtaaaagcgttgattagtgtaaatcaacgcttttttcttctctcacggaggctattatatcaatttctttttcctgtgtcaacaaatgttgaaatctataggttcttccacacttccgccacgtccagattcgtcgtgatctcctggacaatacggtcgctgcttacgctttttacggtaattccattattatccatggctacaaatgctgcaaaaagcataaagcacaggaataggcgcagtccaaacgtgcccggcgccatctcctcctcatctccgtacagccttgcataggcgaacttgtaccttggatggactgccggcggcgaatttctgtcactgtataaggaacgggtttcctccagaagctggcgtcttcgtttttccgaatcgttcatgctgatcatcctttcttacttatgtaacaatcatagcctaagaaagtatatgcatgacccatgcctgttcattcctgtttctaacggtccgccagttcttttatgatatcttcccaactgatgcccttttcaaccattagcaccatagcatggtacaggaaatcggccatctcgtattttacctcttccggattcgggttcttggcagcgatcactacctcagtggcttcttctcccaccttcttcaatatcttgtcgattcccttgtcaaacaggtagttggtataggagccctcttttgggttctccctccggtctacgatcgtgtcgtacaccgcttcaaacacttggagaggattggtctcgtcataatcgttgcctaccagcggctggaaaaagcaggtaggattgcctgtatgacaagccgccccgatctggtccacttttgcaagcaaggtgtcgtagtcgcagtcgatggtcagggacttgacatactggaaatgtccgctagtctcccccttggtccacagttgctgcctgctgcggctatagtaggtcatctttcccgttttaatggttttatagaaagcctcctcgttcatatatgccagcatcaggacttcctgggtcttatagtgctgtacgaccaccgggatcagcccctgctcattcgtcttgaactgggagaattccatcatgctttcgaaagatgtcatcttaatctcctcctggccgcatttttccttgaattccacgaaatccatatccgtctggctgacaaactttccagagaggcctttgactcccgggcatttcaatatcttgaacagttccggctcctccatggtgtcggttacgatcacgcagggcacctccgtcacgttcataacagaattgagatccaggcgatgcatgaatatgatctcgctgctatagtcattgatcaggtgctgatgcttgaacagcgcgtcaaagtcattcaaggacaccgctattttctcctttccgaagcgcttcgcggcatcctcgatcagcttcacgctgtccggcttggagaaattcagcatggcgcgcttggcacctgcatacagaatcttcttaatatcttcctgccttctgatatttccgcctgcaaccatgggaatccgtatcatgcggttcatccgcttcatcaggtctatcgcctcgtcatgctcctcgtccgaatcagagaggtcgaagaccagcagttcgtcagccccgtggtcgctgtaatattttgcaagcccgacgacgtcatctgtcattaccgtatcgtcgtcgaaccattttaccgctttgccgcctgcaatgaatatgcagggaatcaatcttttataactcatcatttatgccgcctcctttataggctcccttttgtagtccatgcttcctgaatccttggctcaggtagcgttgccatgtccagtgcttttccaaaactcttaaacagcgcctctgccatgtgatggctattctccccatccagaatgcgaagatggatattcatcttcgcgctgtaggacactgcatagaagaattctttgatcatctccgtatccatatcgccaatacgctctgctgtaaactcagattggaacctgagatagggccttcccgagagatccacagcgcataaggccagcgtctcatccatcggcagcatgaaatgcccatagcgccggattcccgccttgtcgccgatggcctcaaggattgcctgtcccaggacgatccctgtatcttctatggtatgatggcagtccacgtccagatctcccttaaccgtcaccgtcagatcgaataatccgtgccttgcaaatccatccagcatgtgatcaaaaaatccaactcctgtgtcgatctgcgtctttcccgtgccatccagattcagcgtaagagcaatatccgtctctttcgtagttcttgtacaactggctgttctattcatgcttcaagccccctgtcttcgtattttacatccgtctattcaaagcggactttgatggaattagcgtgggcagtcagctgctccgccttcgcaaagtcctcgatatcctcatggattgcctccagcgcgtttctggagtatgcaatgatgcttgatttcttgataaaatcatccaccgacagcggcgagaagaacttggccgtgccattggtcggcagtacatggtttggtccggcaaaatagtctcccagcggctcgctggaatattcgccgataaagatagcgcctgcattgcggatctttgtcatcacgtcataaggatccttcgtctgtatctccaggtgctcggacgcgatctcgtttgcggtctcaatggcgtcctccatggaatccgcgatcaatatgtagccgtaattgtcaagagacttgctgataatcccgcttcttggcagttcttttaagaatgcgtcaacctggtccgatacctgttctgccagttcctcgcttgtggttaccaggatcgcggaagctagctcatcgtgctctgcctgcgacagaagatccgccgccacatatctgggattggcagattcatccgcgatcaccaggatctcgcttgggcctgcaatggcgtcaatgcttacgtggccatacacggcttttttcgccagagccacatagatattgcccgggccaacgatcttgtccaccttcggaatgctctgggttccatacgccagcgcgccgattgcctgggctccgcccaccttgtagatggcagtagcgcctgcctcatgggcggcgaccagggtattcggggtgactttcccgtccttatccggcggcgtcaccataataatctcttctacgcctgccactttcgcaggcatgatgttcatcagcacagaggatgggtatactgcctttccgcccggcacgtatacgcctacccgcttaagcggcgttaccttctgtcccagcatggtcccgtccggcttgctgtcaaaccagctgtactgcctctgcttctcatggtaagcctctatattcttgagggcctttcggataatctccaccagtgccgggtcagccagttcataggcttcctttatctcatcttccgttaccttgatattcgcggcgctgatgactgcctggtcaaacttacgcgtatattcaaagaccgcctcgtccttttctcttttgacgcgcgcgaggatctctgctactcctttttcgtactccccataattgttggggcttctcttcagcaggtcttccagaagattttgtcttgtattcgcatctaaacgttgtattctcatgatagcctcttcctttctttatatcgcgatctgcgcgcgcaatctggtaagaagggatttgattcgctcgctttccatacgcatgctcactggattgacgatcatccttgcagatagcgggcacacttcttccagtacctccagaccattttccttcaacgtagagcctgtctccacaatatccacgatcacttccgacagccccacgatgggcgccagctcgatggagccgttcagcttgatgatctccacggtctgatgcttggtattatagaaataatccttcgcgatattcggatatttggtggctacccggatcaattcatgatgctgcagaagcggcgctgcctccttatgcccgcagacgcacatcttgcattttccatatcccagatccaggacttcatgaaccttgcggccctcttccagaatcgtgtccttccctaccacgccgatatcggcagcgccgtattcgacataagtgggcacatccggccccttcgcgaggaagaagcgaagcttcagttcctcattggtgaagatcagtttccgggactccttatccttcatctcctcgcaggtaataccgattttttcaaacagttccagcgtctggttcgccagacgtccttttcccaaagcaaatgtcaagtatctcatattcggtctaactcctatctgtgctattcacgatcttatgctctccggtgaccagattaatcatggtgatctcgccagatttctttatataaatcaggtttccggcatagtattcttttccatattctacatactcctccagcagcttgcctttggatttcttgatcagttccgtattcttagccttccggcgaaaatctttggcaagggcaatggcttcccgctgctttccctcatcatagaggatcagcgtattcttcctggtataaacgatgcgaaccttctgacggatcagggcgttcatcagttcatcgatcacgatgacaaagccgatggatgcggattccttgccaaacttctcaagcagatggtcatagcggcctccctttacgatggcatccccggtgccaaaggtatagccccggaagataatgccggtatagtatccgtaggttccgctcatgcttaagtcgaaggtcacgaatttctccacgccatagagtttcaaagtatcatagatcttttccagcctttttactgccatcacgcccttggaattcggcgcgatgttcttcgcctgcgccaggatatcgatcccgcctaccaattcattcaaggccgaaaacgcttccttggagcttctctttacctgaatgctgtccaggaactcttccacgccaaaataattccggttattgatcaattcccgtacgcgcagttccgcctcctcatccaggcaggcatcctctatcaggctctggaaaaagtctacattgcctacgcttagctggaattccttaaggccgatggtcagcatagactcgatcaccagcgccagcatctccgcatccgcctccacggaatcgtctcccatcagttccgcgcccatctgggtggtttcccgtagacgtccctgatagttggaatggttgacgaaggtgctgccggtatagcaaagccggattggcagttcctcatcctgaaacagcgtggccgccgcacgggctatggacggggtgatatccggcctgagggccagcgtattcccgtctttatcgaaaaatttatacagctcgttggaaggaacggttccaatctctttgcggaacacatcaaaatattcaaacgtaggcgtctggatatcatgatacccatataagtggaatacctttttgatacgtccttccaatgctagttttttcccacattctacattatatatatctctgactccttccggagtatgtaataatttcttcatatatcctccaaattcatatatcctttacgctttagcgtgctaccatgttaaaaactctattgaattataagcattttcctactctttgtcaagttcctcccgcaactccagatccagattcatagcgtccagataggggacgtagcagcccctcataaattccaggaagaatctggagtccagctcgtcgaaccggaagctttttctgccgccttcttttgcccgcatccagaatctgtggagttcctcgaaccgcatatagtacagaatattcctggatgtatagtagatcaggataaaggcgattcctccctgcttctcgaattcctccatgaacgtcacctgatgttcatgaatattctgaagcggaaatgtctccgccacgcattccttggcgtcaaagcatgccggtatcccctgaacggcgccaatatagtcgatggtgctcctctggtcgaagtaggccagcgtaatctgcctgtgctccttgtccatctttaccggagtgatgggcgtcggtatcttctgcatcagggcaagccctttttccagataccattcgttggtccggttgaccatctcttctaatgttgaacctctaaggcctcttgaattccatgttcccatgttgtctcctttatcagtctccagaatagaggcggaaccttggctgtaaaagtcatcccggatagttcatccaaaggcgcctccatccgggggagctccatctgatatgcatgcagctgctgggcacttgcctgatagcgttccttaaactgccggttccatcctgcatcgccgtatttatagtcccccagaaggggatgccccttggaagcaaggtgcgcccgaatctgatgggtacgcccggtgatcagatgcacctttagcagggtcatctcctggttgtatgcaattggaacatattccgtctcgatcggcgtatcccctgcctcctctatcgtaaccttgttggtcttttcatttttggcaagatagccgtagatatgctcccgtctgcgaatctcgccctttacaaagcaaagatagtattttttcagggtcctgtccttgaaaagccttgccatggcctgcagccctatcaggctctttcctgccacgatcaggccgctggtattccgatccaggcggttgcagatggaggggcggaatgtccgcaattcctctttcgtgatgctcccttctgcaagcagataggcgatcacatgctccaccatggacacatcgtcctttgcggccttctgggacagcatccccgcaggcttattgataaataggacattggcatcctcataaatgatatccagatccacggatacctggtactcttctttgataggtgccaggccggcaaacttcccaatcgtgtcatccgccagaaacagcttcacgctgtcccctacgcctaacttctcatttcctgttgccttcttgccgttgagcacgatattcttcttgcgcagcatcttatataagaaacttcccggggccttggcgagatatttttttaagaacttatccagcctctggcctgcttcattctggctaattattatttctttcatagtagtccttttcagaaacactcattacattgaaagattcagaatgatatttctgatctctctttcctttttcctggtatccgccttttctatcgaggcaatattgttcatcccttcggccctggacaagaaggcgacgtaatcgtggaagatctttaccgtcatcttgtcatagtggctggctttcagcatatcctttatatgctttgcaagaagggtctcgtccgtcctggggctgctggcatatccgcataccacatggccggatattacgatcgcgtccactggcatgactttatcccggctggtgattaccatatcgtagactctggtaaccagaggcgccttttcctcaatctccttgtacttatccggctcaatgctcttgtggggcgccatcgtgatcaattccaccagcatcttggccgccggaaggcagcctacgattgccacgatcgtaaataaattcattcgcgttcctgtctgcatgtatcccaacacgaatatggcgatcaccactccaaattctgcaatggtccagatcagatacttgaccttgcgggccttcacatatcccggctgtcctttctcaatcttcatcattttgtacactctcccttatttcccttattgtcctgattcgcggctttctttgttcatccacgccatcgcgaacgcgatctgcgcatccggcatgatctttgaaagcacccgggcccctttcatggctgcgccatacacagatgccggctttctcctgactgaatcccttaacgcctgcctgactacgcctgttacatcggcccggacggtcgccttccaagaattcttaagttctcctgcccgatcgaaaaattccgtgtccacggggcccggacacactgccgtgactacaatgccacggtctttcacttcttcccgtatcgcctgtgaaaaactgtatacataggattttgtagccgcatacacggcaaatcctggctgtggagcgaacgctgccgcggacgcaatattaattattctacttccttttgtcatatatggcaagcataagagcgacagccgggtcagagatctgcagtttaagtcgaccatttcgcactgctcatctatcctcaattcctccgctgctccaatctttccgtatcctgcggcgtttaccagcatccggatatccgcgccacatctttccaattctttttctatccgcgagaagatgtaatcccgcatcatgtcgccatcaaagatccggacgggaacttccgattttctcgccagttctttcagcctgtcggtcctgcgcgctactacccacagttcatctaggcttttatacagcctgggaatctgccgggcaaattctctgccgattcccgaggatgccccggttatgattgcaattctcatcacgccatctccttacttcttctttcttctatgcacattacggatcgtcttcttcttggtatttgcctgagaatccgctccttgcttctttcctgattttctgtccggcttcttatctatctttctcggcctgatcagacaatgcttttcaaatcccacaagatccatcctgccttcctttcgcaaggcttccattaccagatcatagttcttcggatcccggtattggatcagcgcgcgctgcatggccttctcatgcggattcttcggcacgtatacgggcgacatatccctgggatcgacgcctgtgtaatacatgcaggtagatatggttgacggggtcgggtaaaaatcctgcacctgctccggcatatagcccagatcccggagatattccgccagcttgatggcatccttcatagtagagcccggatgggaagacatcagatagggaaccagatactgatccttggaaatctcctggttgatcttcttatacttttttacaaatgactgatatacgctattctccggctttcccatcttcttaaggactgcgtccgagacatgctcgggagccaccttcagctgcccgctgacatgatatttgcacaattcccgcaaaaatgtatcgtctttatccgccatgacatagtcaaagcggatgccagaacggatgaacactttcttcacctttggaagcgcccttaattctctcagcagccggacataatccttatggtctgccctcaggttcttgcaaggcttcggaaacaggcactgcttttccttgcacacgccgcaagtcagctgcttttcgcaggaaggctgcctgaaatcagccgtaggccctcccacgtcatggatatatcctttgaaatccttatcctccgtaagcttcctggcctcatcaagcagggattcatggcttcttgtctgcaagatccttccctggtggaaggtaagggcgcagaagttgcagcccccaaagcatccccggttgctaatcaggctgaacttcacttccgcgatagctggcacgcctcccagcttctcataggaaggatggtacgtcctcctatacggatatccgtagacctgatccatctcggactcatcaagcggcatggacggcggattctgtaccacgtacagatgctcattatacggctcgaccagcctctttccggtaaatggatccgtattcttgtactgggtataaaaactgcgcgcatacgcaagtttctcttctttcatttcttcatacccgggcagggatatggcgtcgtagacgctctccaaactcttggtccggtatacggttcctggaatgaacgtaatgtccttgatgtcgattccgctctccagcgcctcggcaatctcaacgatagaccgttcccccatcccataggagatcaagtccgcgccagaatccagaaggacggagcgcttcagcctgtcagaccagtagtcgtaatgcgcaagccgccttaggcttgcctcgatcccgcccagaataatcggcgtcttcttgtagacctggcggatcaggttgctgtaaaccaccgtagcgtaatccggtcgtttccccatgacgccgccaggggtgaatgcatccgtgcgcctgcgcttctttgacacggaataatgatttaccatagaatccatattgccggcagataccaggaatgcatatcttggctccccgaattccgtaatgcttcgcttgtccttccaatccggctgcgcgatgatgcataccttatatccatgcgcctgtaataaacgggtaatgatggcatggccaaaggaaggatgatccacatacgcgtctcctgacacatagatgaaatcaggcctgtcccattccaattcttccatatccttcctgcaaatcggcaaaaatcctgtttccatcataatacctcgtaagtctctttcttgatgtcataataatcctgtatgtagtaatccgccagtttcttctttttctcctcctggggcctggaaaagtcgtcatccaccgcgcatactctcataccggcatttttcccggccagaatgcccatgggaacatcctcgaacaccaggcagttttccgggcatacgcccatctctttcgccaccagaaggtagacatccggagaaggctttcccgcagccacttcgcaggcgcttctcaccgagtcaaacagttcttctacctccagggcccgaagcgtgtcatccaccagtttcctggcattgctagtggcaatcccgattttctttccctgtcttctcatctccaggataaaatcacgaacgccttccttaagttctacctgggtcatatatttatcatacgccatatccatccattcatccatcacttcctccagggtgaggtcaagttccggaaacgtgtccaggaaaaactgggccacttccgtgtaactcataccttccatatcttcatggaaactgtcggtctttgtcaaatgatactttgccagatagtcgtcgtctatggaaggccagatccacatcgaatcaatcagagttccatccatatcaaatataatcgcttccacatcttcaagcattttcgtctgcaacatcttctaactccttcttcgtaagcggccggtattcccccggcttaagcgtctcatccagtttcaggctgcccattgattcccgcctcaggtagaggacttccttgcccacggcctggaacatacgcttcacctgatggtactttccctcctggatggtgaggcggatctctgatacttcctcactctttagaatctccagcacgcccggcctggtccattcttctttctcttcggttcctatattgacgccctcccggaaggcttctgcgtcctccttcgtgacccgtccggccacctgcgcgtagtaagtcttgtccacatgcttcctgggcgacagcagccgatgggaaagctgtccgtcattcgtgataagaagcagcccctccgtgtccttgtcgagccggccaaccgggaagaggtcttttcgcttcttatcccggatcagatcgacaaccgtcgtacatcttgcgtcttccgtggcagacacgacgccggatggcttatttagcatataatactcatagtccgcataatccacttctctgccgtcaaaggttatcttgcgcgccttttcctctattttcgtctccggcgacttggcaggattgccgtcaatgctcacccgtccctgacggatgtatctttttacttcctggcgggttccgattcccatatccgccagatacttatccagacgtatcatcagcatagcctccatcccggcaggtacttattcttcaatgctcctccggcaagcttgccccagcctaagggatatccgtccacgcataccaggcaccatcccttgctgatgggcagcgtcatgtcagcaagttccagggtctcgcctttcagatacctccgtacccgttcgtcttctgccggaagatcaatgcaatgggcatactcgctctttttcaggcacatagccagtgcctggcttggctcaaaccggttctttttcaattcgcccagaagaaggccggttcgcaggaaacggattccccgcacatccggaagtccttccggcatataataaacccgttctccccggatatccagcctttgcgtttccagattccaggatacgtcacgaaagaattgctccaactcttccggcatcttccgggtgttcttctttcttaattcttccggcgctttcttctgcgcctcgccttttctcagaagcgccaggtaatgtccctcccccttcattctgtgcggaaatatccgcaccgtcttcgcaagttccggatcattgttcttagcgcactgtggcattccctggcagaagccggaataagggctgatcttcagaatctggaattcgggacaggcctccctaaggtgctctatgatccgctcattctccctgccatcaaaggtgcaggtggagtacagcatcatgcccccaggctttagcatccgcgctgcctggaggatgatattcttctggatgttgctgaaaaactccggcccatgctcttcccaagccttcaccatcttcttatccttgcggaacatcccctctcccgagcagggggcatcgatcaggatcttgtcaaaatactccgggaaatactgttcaagccttcccggctcttcacttagcaccagcatattgccaatcccaaaaacttccatgttcttaagaagtcccttagccctggaactgctgatatcattggcaaccaatatcccctggccctttagtcttgctcccagttccgtcgccttgcctcccggcgcggcgcacacgtccagcaccttgtctcccggctccaccggaagacggctggccggcgtcatggcgcttggctcctgcagatagtaaagccccgcaaagtagtatggatgcttcgccggcgccacgttctctccgtcataatagaatccattctcaatccatggaatcggcgttatctcaaaagggcagatccgttcaaattcttccaccgttatcttggctgtattaacccgcaggccatagtatcttggctcctcgtaacaagctatatattcatcaaactcttcttgcaagagtcctctcatcttttcctcgaatgcgctgggtagattcattatccatcctccgtcagtaagtatttttttacatatgtagttaagtataacatattccatggtataactctaggaatatgcatactttaatttcttattttccagatacagcaacacatagtaaggatttacgctgacttccctgccttcttcataagaatagattcccacatggagatgcacgtcaaatttgcccttcgtcccctcttccccatatccggtatcccccatatagcccagcagctgtccggccttcacccggtcccctttctggatgttcgcataggaatccaaatgtgcgtagtaataataagtaccactatctgccgtcacgccgatccggtacccgcctttctccagccagcccaggtttgtaattgttccgtccgtcatactgagcacaggatagacgcctctttcgttcttcaatgccataatatccgtcccttcatgcccgctggttcctttatatttccgttctcccatccagctgtcaacataggagactttcagcgacttatccacagtggattcggggattgggaaataagtcacttcgttttccacattagagagcatctttctgcacgcttcagacagaaggccttcgtgctttctcatagcatcgcaaaagaattccctccgatattcttcgtcctctatcgtctttttctggagggtattgtaatggctcagttccttcaaatagtcggttccgagtactgtaaataaggccagcagcaatatggccagcagaattcttcccggtgttttctgattcataaggtcaattcctttttttatcactatatgcaaaagagccggatccctatgcctgtagggatccggctcttcctgccgggttatctgcaattttcaagaatttttttcaaatattcccaggtacgtccggtagactcaatatccagcctttcccggaaggaatggacatccgggatattcggtcctacggatacgcagtccagatctggctgctgtcctacgaacaatccgcattccagtcctgcatgcatggttgatatagccggcttaacgccatacagttcttcatatgtatcttccataatccttcgaagcctcgaatccggattaaactgccatgcgggatactccgaggtgatcgttcccgtacctccaagcgccttcacgcactgctccacctgctcgaagagctgggtcttcctgctttccacggaacttctgatcaaatgcacggttctgatataatcggatgccgtctccacaatgccgatattcagcgaagactctaccactcctttgaggctgcggttgaatccctgcaggccgtctggacaaatttccaggtaagccacgatccgatccgtagaatactggtcgcacacgtccaccgtagaatcatgggataccttcatgtccaccgccagatcaggctcgtcattcaagaattcgtcattccagatcccggccagctcgcgaatcatgcccatcgccttttccgcctgggattctggaacaaggatctctgccacagactccatggcaatcacattgtccttggtaccgccattaatctccaccagatccgcaggaatctccttggtaatacggtataaaagccgccccatcatcttgtgggcatttccacgctgtttgtggatctccgcgcctgaatggccgccctttaggccatggatcttgacggtgatcaggctgccggacttcttctccctgtggataggaagccttgtctcatattggataccgcctgcgcatcccgtcgtaaggatcccctcttcctccgaatcgatattgatcagcgtccgtcctttaagcaatgaccagtccaccgcttttgcccctgtcatccccacttcctcgtcgatggtgaacagggcctcgatcggaggatgcgcaatatcgctgctgtcaagcactgccataaccatcgccaccgctatacagtcatctccgccaagcgtagtgtctttggcctttacaaagccgtcttccacatataattcaagggcgtcttttgtaaaattgtggacagatcccggctttttctcacaaaccatgtccagatgcccctggaggattattggctttgagtcctcatatcccggcgtccccggcttcttgattatgacatttcccactttgtcctgaatcacctccaggcctctttccttcgcaaatgctacgcaatggtcgctgattcgccgtgtatcgaaagtgccatgaggaatcctggacaattcttcaaaaaatcgaaatactttttcaggttctaccttctctaatactgccatcttagttatcctcttttcttaaattaacctatatctatgttctattatgaaacagcccacataaaaaatcaaccggttccatagaataaaactaaagaaatatgactggatttaaaaccgcatgaaacgatactttacctccctttgcgtcatcgcgctgtttgtccttatgctgctatttccacagccggtgttcaaaggcgcaagttccgggctgcttttatggttcaatgtaattctgccaaccttgcttccctttatgatcgtctcaaacctgctgatcggtacccgggccattgatgccatctcaaaagtcttcgggccagtcatgtgcaggctcttcggcgtgaccagatacggctctttcgccatcatcgcgggctttctgtgcggctatcccatgggcggaaaagtgactgccgacctggtaagaaagcagtacatcacctggcaggaagggcaatatctgctatcgtttaccaacaacaccagccccatgttcattatcagctacgtcgtatggcagaatctaaaggatacgtcacgcactatgcctgcattgctgattctgattctctcaccgatcctatgcagcttcctctttcggatctactaccggccaggtgcgagaatccattcctccggatgcccgccgcttccaaaagcagccgccgcaagcctgatggattcctgcatcatgaacggatttgagactatcacgaaggtggggggatatattatgcttttttccattctgatcgctttgctccagaaactgcctcttgatcatttcctgttctctctcctcctccttccatccctggaaatgaccaatggaatccctctgctgtgcgcctcgcccctgtccgcagatgcctgcttcgtcctgtccctggcacttacttccttcggaggatggtgcagcgttgcccagacccggtccatggtgcagggaacccggcttcctatcacgccctacataatagaaaagctgattaccactctggtaaccagcctgcttgcctatacttatattcgattattctaattcgtcgtcttcatcaaccagatcgtattccggttcaggctcataacttccgtattctgcctcaagacctctctgggactgttccggaatctccagttccgaacggttgttgcgaaccatatcataacactcctgcaaggaattcacaagaccgtcatatttggtcgtataactgtcaagcgtatgcccgataatgctctctgcgtttgacagaagatcatctgtatactgcatcgcgccaatacggatatcgttggcatcattcgttgcgttgtcgaggatctgctgcgcctgctctgtggctgccgtcacgatctcattggcctgggcatacgcctgctgcatgatctcatgctcgctgaccagttcattggtatggatctgcgcttccgcgatcatactgtcagccttggcctgggcatccgcaaggatcgcatccttgttggcaataatcttctgatacctctttatctcatccggcgtcttcatgcgaagttcacggagcagttcatccatctgatccttgttcacgataatcttcgacgtagacagcggctggaacttgcaactgtcaatatactcctcaatctcttcaataatctgctcaatacggctgctcataatttacactctccttttattcatcttctcttctatcaagtctgcaacgattcctggtacaaactgagaaatatcccctccaaaagccgccacttcttttactgtggtagaactcaaatacgaataatccaggcttgtggttaaaaatacagtctcaacatcaggttccatcttatgattcgtctgagccatctgcagttcgtattcaaagtctgtaattgccctcaatccacgtataaccaatcccgcatccatcttacgggcaaagtccaccagcagtccctcaaatggaactaccgtcacatttggcatgtcttttgttacttcatttaacattctaacacgttcttctgcggaaaacaacgggctttttgctttattattcaatactccgacgattaattcatcaaccaattttgaagatctttcaatcacgtccagatgtccataagtgaccgggtcaaaactgcccggatagattccttttaacatatttctttccttcctgacggctctataaacacatgcttattcgtcttatactctttggtcttgataatattgagccccaagtcctccacatagtcgaacttcgtctctttgagcgcctctacgatgattacgccttctgcagccacaaggctcgaatctgccaggtactcaagcacccgattctccagttccttcccgtaaggcggatccaggaatatatagtcaaactgcttttctccctccagcttatataaggcggtcatgacgtccatcgtcatggtcatggccttatgctccagatgggtacgcgtaaggttttctttgatgcaggccatagccttcggattcttctctacgaatacggtctccatgcttccacggctcagcgcttcgatgccgatgccgccgcttcccgcgaataggtccaggaacatgcagtcatacaggtatggtgccagcatgttaaacaaagtctctttgatccggtccgtcgtcggccgggtatccatcccgtccagcgtccttaactggattctttttgcgctgcctgcgatcactctcatcttccactcccccttaactgccggtatcggttcaggcaggcgtagatctcctgctttcttggaagcgccagatttcctgccacacagccaccttcgctcaatacgtcaagcccctgcgctgcaagtctctgattcatctcttcaatggcctgtcccagggttctcttgccgtcaaacaatttttcctccagatatcttacgatattccccaggctggtcagctgttctgaatccaccagctgctctacatatcttaaatcaatggtatcatggttcagcatcacgccgtccctgcctaatgtctttaacttgactcttcctttgctcctgatacccggattgcttctgaccatgcgatcaaaggaaggccgcgcaggcttctcttccggcagcattagcttcggatactctttggccgcgtctttcgcaagagcggtaatctcttttggcacgtaccggtccatctgcaccacctggtcagccacttcaaaatatgccccggaacttccggccacgatgaccgtggatattccgaatatctcatacagatccctcacccgctcaatgaaaggggtgataggctccatatcccggtggatgactctctgcatcagttcgtcccgcaccatgaagttggtagcgctggtatcttcatcgatcaagaatgtcctggcacccgcttccaggccttccactacattggcggcctgtgaagtgcttccgctggcatcctccgtctcaaaggaaacggtatccttgccatttggaagatcacttatgaacatggagatatccgtccgcttaatgcttcttccatcttccgcccgtattttaagcgcagtatcttcagtaaccacatactccctgccatctccggcgatatgcggatatacgcctgtttccagagcctttaaaagcgtagatttcccgtgatatcctccgcctacgatcagtgtaacccctttgcggatacccatacccttaatccttcccctatagggaagatccagggtcacttccatcgaagaaggagatacgaaaggtatccctcccttcatcggacgctgggatactccggattcccttggcagtaccgatccgtttgcgataaacgccaccaggcccatctcatcaagatggcttcggatataagcctggtcaacggatagttccatgacccttcttgccttttccggatccagactggggtagcacaaagccttgtccacgcaaggcggcagataatcatacaagatcttaatcagttccctggcattgatggtccttccatttgccggaaagcctacctcgaatcgcaccgtcacatccccgcttctttcatcaaccttgcaggcagttctctccagaacttcctgtccgcatctggagatggatatgacgccgcttttcccggaacctttggcctgataagaataatgctccgtctgtctccagaaattccgggtcagataatcctgcagcgcgatccgcttatgcttcttgtcatacagttcctttggaaaggcagccgcctttcccggcactttgacgcttaatctggatggcgcagcgaaaggatcgccctgcacatggtctatggacagcacatatttgccaaactggtatgcgccccttgtatctttgtaggccggataactccggtggtctattcgttccaataaccgtcttaaatcttctgctgtcttcatctgccactgttctcctactctataaatccaatcttataaatccacgattctggctctgtggtggatggaaggaaggaacttgttaagcagatccttcgtcttgaattttaagtggctggtattgatgcccggattacatccaaaccattctgcctcagctacttctttatccacgattacctgcacatagtcgtcttcatccatcaggagccctgccacgcttgctgagcctggcgtcgtccctaaatgctccatcatcttctccggcggcgcgaaagacatatgggatactcccagcttcttgctgaaagatgccgtgtcaaacgccttgtccgcaggcattaccagcagaaagaaggtcgtctttttctggttgcataaaaatacgtttttgcggatctgagtgccaatggctttatcgatcgccgcgcattcttccatggaagccgccggatcattgtccacctgctcgtatggtatctttaacttgtccagcgtgtcatacatctttctttccaatggcattctttcatctgtcggagccgatgtcctgatttcactgatatacattttcttcttcctccattatcctattgtcctatttttaacattatagcgaatccttgacgcctttgcaaatccttcgcataatacaatgtgcatattatatcatattctgctataatatgcacaaaggaatcaaaataaaggaattaaaataaaaggagaatcatcaatgaaatacattttagcctcggcatcccccagaagaaaagaattgttagagcaggcaggattccggtttcaagtcatcccttcctccgtagaagaaaagatcacaaaagacgcgccttcggaaatcgtcatggaactggcttcccagaaggcacgtgatgtatatgaacattatggggatgcagactgcgtggtgatcggcgcggataccatcgtcgcatacaacggggaaattcttggaaagcccgccaatcagtcagaagcctatgatatgctggccatgctggcagatcggacccatcaggtctttaccggcgtctctttgatcatggccaaaggaggccaggtccatacccgtaccttctttgaagccactgatgtcaccttctatccgattagcaaggaggacctgcgttcctacacagagacaggggattccttagacaaggcgggagcctacggcatccaggggccttttgccattcacgtcaaatgcatccgtggagactataacaatgtagtgggccttcccgtcagcagactctatcaggaactgctccgggagtacgtatctcctttgtcacttccataatcatagttttttttggaagggctcttccatcctgaggagatctgccgccgcaggtctgtatcatacctttgcggcggcttgatatccagcattttatgcatcacatcattggcattagcgtaattaaaggattccgtatccataatctgacgctgtgcgccttcccagtcatatgcttctccggttttctgatatttgcggcgatagtatgctatgtcgctgatgaccctgcctttttgatcttcttccagcacgttccactggcttacaaaatttccatggatatctacaatgaattccgcatggaaatccggcgacacgcgctttttattttccctgccctttgcataccttttgtaatcggaatcggacgggtatttattgtgaagccgggcaggctcccgaagcagcctctgccctcccagccctcctgcaactgcaggcttatgcacgtataattccagagcctcttcatccgtcattccaggcttcttaaagcgccctctgatatagcggatattgtggcggtcgatgtacatgcggaactgatgcagcattcgtgcctgcgtcacattcttaagccccatgattccctgttcgccgcaataggcacggatgctttctgcataatgtccgaacgcttcgctgtgaggcggcgtattcttgtcaaacacgaatccatgccccagctgcagcatgccatgaatatccagataaccgccgcattttcgaagcagttccataggatccggatacatacgcattcctcccgttctgtccttgcagcgtttttattcctatgttattatattccatagcaaaaaaaaggagaatgatcatgcactcaagccagttaaagcaaaaatccgaaaaatcagccttaaaaatatccctgaccggcagcaccgtcttcgttggactggaattgctcatggcaatctataccagttcccaggctgtccttctggatgccgtctacgatggcgtggaacttttgatgatcttcgtatccttgtccctggttcccctgctttataagccctccaacgaaagccgcccctttggctatctgcagattgaatccttgtttgtcgtcgtaaggggcgccatcatggttgccgtaaccgttgggctgattgtaaataatatccagatcatccttcacggcggccggcacgtaaacttttccgcagtggcttattttgaacttgcggctaccgtgatcagctttatcgtcattcttcttttaaggcgtatgaacgcagatctcacttcgcctatcgtcactatggagattcaggaatggaagatcgacgcggtggcatccttaggaatgtctgccgctttctttctccctctgctcatccaggccgaatggtttgttccccttaccaaatatctcgaccaggccatcgccatcatcctttcgatctttatgctcccagtgccggtacgcgccgtgacaaccggccttagagatctgttccttctgccgcccgaagaagagacggtgcaaaatatcaaagacattataacgccgatactggatgcctacggctacgacaaactctacttcgacatcgttcggacaggccgtaaattatggatcagcgtctatattacttttgaccgcgacgaagtctccatctcccggttccgtatcgtgcagaaattcatcatacaggccctctccaaagagtaccaggatttttatttcgaactgcttcctgacattgaatacaatgacgagacggaagtctaagaaaataacggaatcctaggcggatttttggcctttttcgtagtacttttttgctgccgcgccgatagactctttcaagatctccatcaagtcatctacctgctttttcgttacggtcagcggcggaatcatccggttcaccttgtctccaatggctgtgatcaaggcatgcctgttcagcacctcatgctttacttctactgcgatcggcagatcgtattcacatcccacaagaagtcccctgcctcttgcttctgccacatggggaagccttgccatcttctttagcatatacgcgcccacttctctggcatttttactcaggtccttatctagaatctccgttacagaagcaagcgcagcggcacatgccagcgcatggcctccataggtagagccgtgggttcctgtcccgaatgcacgcgctaatttttctgtcgcgcagcatgcgccgataggcatgcctccgcccatggcttttgccatggatacggcatccggcttcaccccatatcccatgtatgccattggtgccccggtacgtccccatccggtctgcacctcgtccagcagaagaagcatgtcattgtcatcgcacagtttgcgcagcccttccatgaattcccgggtggcaggatgaacgcctccctccccctgtacaggttctatcatgatggcaatggtattcttagttacctttgacgcaaaatccttcagatcattgaatctggcataggagaatcccggaaggacaggcttgaatccgtcctggatagggccatccggctgccctgtggcagacagggctccataagtccttccatggaatccgcctttggctgtgatgatatggtatctttccgggccgtaattgtcgacgccatactttcttgccatctttatcatgcattcattggcttccgtccctgaattctgatagaatatcttatccatcccgatcgtatcgcatatcttctttgccaggattgcctgaggcacggtataaggatagttgaacgtatgcacgatgtcatccgcctgctccttgattgcggcaatcacctttggattccggtttccggggctgttcaccgccacgcctccatagaagtccagatatgcatttccttcatggtcatagagatacatgccttccgcccgctctgcgataaaatcataacgctcataagtctcaatcatatacttctctgctatttcttttagttcccggggtgtcaatcctgtgtctttgagtctcatcgccttctcctcgctttctttttcctacatgccgtcgaatacaaaaagggcgccgtatctatgatacggcacccttgcctttaacgtctccagtatatacttccatttctgaaaggtcaatacttttttaggattctttggaaaacaggcttctgaaactgtctttcagttcccagaccttgtccgggatgtcatccttcttctcttgatacatggtatggaagaagtcgcagatatacagtgcgattataagcgttcctccgattctgccggcaatgaccggaatggcatccaccagatttaccacgacattatgcaggaagaagaacagcataagcgtatagaagccccaggctatcgaactttccatacagataattcctttataattgcacggtttctccttgtaatcccaccagatctcaccgaatatcttattcatgatcaatgcagtcagaaattcgattgccgtagccagcaccattcccagcacgaacagcgtgaaaggattctggctgtatggccgtaatataaagaataccgtcagcgcccctacgccatatatcgggcagtaaggcccttttgcaaatcctctgttggtcagcttgcggttacagactgacatatagatagattccacaatccagcccataatgctatagaccagaaaccaaagcaccacatgatatgcactccatccaaatatcaccttgttccaccacataatagtctccttatagaaaaagcgtgcagcgataggaaacaccatttcctattacataaaaatagagtgttgaatcgtccaacactctatttattgcacatattagttatacttacgttttctagcagcttcagattttttcttacgtcttacgcttggcttttcgtaatgttctctcttacgaatctcctgctgaatgccagctttcgcacagtttcttttgaatctgcgtaaagcgctatctaacgtctcgttctctttaacgattacatttgacatagtctcacacctaacctccctccagtcctatattgtgcatcatacgactgttcgggtatttttattgcactacataagattatagcacatatttcctctacgtcaatattttttcatcatttttcacgatattatttactgatttccgtttgctgactgccatatagaccgggaggccgatcagcgtcactgcgatactgcctgcggacagcagcgttgactgcagcccggacatgaatatctggttaatgattacgtagattccgcttatgatcgcgatcaatggcaccaccggataaagcggcactttataagtcctgaccgcatcaggacggtcttttctcagtttcataacgccgataaaagtaagcgtatagaaggtccagctggaaaatacggcaaggtccgtcagcaggttgaactgcccgctgattgcatagatacagccaattcctcctaccaggatgatggaatttgtaggaacctgcgccttattcagccttgccagagacttgctaaatgggaaattgccttccgctgccagggaatatgccactctggagccggataatacaaatccgttgcaggcgccaaacacggatatcatgatgccgacggaaacaatcttgcctcccacatctccaaagatcttcagggccaccgcagaagcaggcgctgtcattcccgccagctcgcttgccggaagaacccagaggtatgaaatgttgataataaagtagacgcccatgatcacggatacgccgccaacgatcgcaataggaagatcccttcccggattcttcatctccccggcaatagcgcctacattggtccatccttcaaaagcaaacaggatggcaaccatcagctgcccaaggacaaccgccgggctaagcccgtctcccaccattggcgtaaagatcgggtttgccccgccgccctttatgaatccgaatatcattagcagaatcaaaggaatcaatttgcagacggtaaagatgatctgcacgctgccgcctacctttgagcccaggctatttaaaaagatgatcaggatgataatgccaatcgcaaggggcaccgtgaatccatcgccgataaacagtgccgcctgctgggcgcatacaactgccagggcagacgtcatagccgggtagaacaatatggtctggacccatcctgccaggaatcctaccaccggattgtaaatttcttccagatacgccaccattcctcctgtctttggaatcatgatagcaacctccgcgaaagtaagcgccgcggcaatacttgcaagcccggtgatgatccaggcaatcatgccgagtcccggtgcccctcctgtagccgtgtagatagcctgcggcttaaaaaacacgccggagccgatgacgcagccaaccacgatcgccatggcagtcgcaacgcccagattcttcttcagtcccttcttctcttccataactcttatctcctttgcttcgttttaaataatttttcagataaaaaagagggtacaagacacgcaaataacggtcctgtaccctctgtatttttacctgaaagttttacttctacggtggccttataaaaaaggctctttccagagtcccatccatagcgggtattggcacctgaaagtttctcagagcggtcaggagcctctctgattgcttcatcggttttccgagtgtatcatacggaaatcttcctcgctacttcatctggcaatattcatttgtaaatagtatatgtgaaatcctatttactgtcaaccatagttatttttgtaaccttcctgacaagggacagacaattacgccagctggccttccagaacttctgccgctttcgcgattgcatcctccatgcctgcaggattcttgccgcccgcctgggccatgttcggacgtccgccgccaccgccgcctacaaggccggcaatcgctttaataaggtttcccgcatgggctcccttgtcgatagcgccctttgtggctgtagccatcaggcttacttttccgtcggttgctgacgcgatcacgatgacgccttcgcctagtttttccttcagctggtcgccaaggtcgcgcaggccattcatgtccacgccctctacctttgtcgcaaggagcttgacgcctttcatctctacgacctggtccatcacatctcccatggcatcctgggcaagcttgctctttaaactgtccacctcgctgtggagcgctttattttctgcctggagatgggtgatcttctccgtcagcttatccggggcagcctttaacagtttcgctgcctcatggagtttttcttccagttcgtcataatatttcaacagccctttggatgtcaatgcctcaatccttcgaacacctgctgcgacacctgtctcggaaagaatcttgaaggcggtaatgacgccagtattggccacatgcgtgccgccgcagaattcgatggaaaagtctcccatgcttaccacacggacgatgctgccgtatttctctccgaaaagcgctgccgcaccagtctttttcgcctcctcgatgggcatattctgaaccttaacgttcaggcagttcatgatctgctcattgacgattgcttccaccttctttaattcttcctccgtaagggcagaaaaatgcgtaaagtcaaaacgcagcctgtccgcattgacagaggatcctgcctgctctacgtgattgcccaggaccatgcgaagcgccttgtgaaggaggtgggtggcactgtggttattggcagaaagcatccgattatccggatctacttccagcgttgctttgtccccaaccttgatcatgccctttgatacatagccaatatggccgaatttgccgcccagaagctttaccacatcatccacgataaattcgccgtccgcggtgcggatgattcctttatccgcctcctggccgccgctggtggcatagaatggggtctccttaacaaatatggttccccgctcgccatcggaaagcgcgtctgccagttccgtatccgtagcgagcaccgtaacttcggactcataagaaagattgtcatagccgacgaattccgtggtaatgccaggatcgatggactcgtatatcgtcacgtccgcccccatataattggtaacctcacgggcctcgcgggccgtcttcctctggatctccatggcttctttgaagcctttttcatcgacggccattcccttctcttccaagatctccttcgtcagatccagcgggaatccgtaggtgtcatagagtttgaacgcattctggccatccagggtcttttccccctttttctcgatctccgtcaccatatcggccagaatggacagtccctgatcaatggtcttgttaaactgctcttcttctttggcaattaccttaaagataaattcctttttctcttccaattccggatatccatctttggagccttcgatcacagtctgtgccagttcaaccaggaactctcctggaatgtcaagcaatcttccatgccttaaggcacgtctcaggagacgcctgagcacatatccccggccttcgttggaaggcatgatcccgtcagaaatcataaaggttacggaacggatatggtcagtgatgacacgcagggagacatccgtctcttcatctctgccatattcggcatttgccaggcggcagacatgatctcttaaggctttcatggtgtcaatgtcaaacatggagtctacttcctgcacgatgcaggccagacgctccaggcccatcccggtatcaatattcttctgctccaattccgtgtaattattatcgccatcgttgtcgaactgggtaaagacgttgttccagatctccatatagcggtcgcattcgcagcctaccgtacagtccgggctgccacagccatatttctctcctctgtcatagtatacttcggaacatgggccgcaggggcctgagccatgctcccagaaattatcttcctttccgaaccggaagattctctcggccgggattccaatgtccttgttccagatctcccacgcctcatcatcatccagatacacggaggggtagagcctgtccggatccagtccgacgacctccgtcaggaattcccacgtccagcggatagactcctttttaaagtaatctccgaacgaaaagttcccaagcatctcgaaaaaggtgccatgacgggcggtctttcctacattctcaatatccccggtgcggatgcacttctggcaagtggtcacccgcttgctcggcggaatctcctgtccggtaaaatatggctttagcggcgccatgcctgagttgatcagcaacagactcttatcattgtggggcaccagcgaaaaacttttcattgcaagatgtcccttgctctcgaagaattcaagaaacatctttcttaattcattaactccgtatttctgcataacttcctcctgctttcttattctatatatatgtttcatatccttgtattgcaacggtatggctaagttttaattataaagagaagcaggcggtttgtcaacgctccgcctgcttctttatccttactttaattcaatttcttctaattctttggacggtattttcttcgatgagccggccacgaattcctttaccttcttctgagcctttgcaacctgaaggttggttccggctcccgcgacacatccgcccgggcatcccatgccttcgatcaggcaaccgttcatctttcctgcctttgcaagagccaggatcttcttgcactcggcaagcccttccgcatgctcgatgttgacgtccacgccgggataatattcgttgatgcatttttcaatggcctctgcaacgcccccggccaccgcgtatcctcttcctgccccggtggcatcatggaaggaggattccgcctcgtattctttaaggtcgatatccttggcatcgaacatggcctgcagttcttcgaaggtcaccacgaagtccacgtcgcttcggacgcttcttctcattgcctccagtttcttggccgcgcatggcccgatgaataccacccgcgcgttcgggtgttcctttttgatggtccgggcagtggctaccatcggcgtcaactcctgggatacctggtcgatcagatccgggaactgctttttcgccagcattgcccaggatgggcagcaggacgtaagcaggaacggaagttctccggtactaaccttattcacataatgatgagcctcggctatcgctccgatgtccgcccccagcgccacctcatacacttcgcagaatcccagttcgtgaagggcggcctttaagttccttggcgtgatgttgtccccgaattgcccgtagaacgcaggcgcgatctcggccacgatctcgtccccttccgtcagcgcccttgccagctggaatatctgggacttgtcagaaatggctccaaacgggcagctgaccatgcacattccgcaggagacgcatttgtcattgttgatatgggcgcgtcccatgttgtccgactcaatggctcctacgccgcaggccttctgacagggacgttctttcttcgatatggcatcgtaaggacagacggacttgcactttccgcacttgatgcatttatcctgatctatgtaggatttcccccctaccatggaaatcgcgtctttggggcagacctctatacagggatgggcgaggcagcccttgcacatgttgctgacctcgtaccctcgttcctcgcaggcctcgcaggcagaaggaatgacctgcataagcgggggctcgtaatatttgtcggatatattgctggcttccacgccagcggtcagatgcaccggcttattctccgggcgcagagacagtcccatggcaagccggagacgctcgcgcacgaccgcgcgggcacggtagacgctttctctgtatttctgggtctcttcatttaccatcttatatggaatggcttccatatcgtcattcagcgtgtcagcgttggctttaaatccaagccttgccacttcctcgaatactcttcttcttaatcttctgacggtcgtatcgattcctctcatcataagccgaacttcctcctaaactttcgtagattctggtaatactataattaattgacaaaaaaatgtcaatacgtttccatgttcaggattccatacaatcttacaagattttacagcaggaatatcttgacttgcctattcatgtccgaatatgcgctgggcataatagacagactgcatggcgtccttgccataaaagtccgctccgatcatctccgcataatcctggttcagcacagctccgccaaccatgactttacagtccggcttatgcttacgcagcagccggatcgtctcttccatactggtcacggtggtggtcataagggcgcttaagcctaccaggcttacctcttccttgatggccgtctccacgatcgtcttagggggaacatcctttcccagatcaatcacatcgaaactatagttttccagcagcaccttcacgatattcttgccaatatcatggatgtctcccttgactgtggccagaatgatcttatcctttttctccatatccccgccgcttttcgccagttcgtcttttagcaccgcaaaggcgatcttggctgcatccgcgctcattagaagctgcggcaggaagatggttcccttctcgaatccttttcccaccacgtccagggccggaatcagatactggttgataatggaaagcggctcctgctcctttagaagcgtccgcgtcgcatggtgcgcttcttccttgaggcctttttcaatggcctccttaagggtcatcctggagccttctgatgatgcgggaagtacaggctggcttccatactggcggatataagcctcgcagttgctgtcataattcatcagcgcgcagaaggaataataggaacgcatcatatcctctgaggaaggattgatgattcccgcgctcagtccgttctgcatggccatcgtataaaagttggaattgatcgctggccggtatggaagcccaaaggatatgttggatacgcccagcaccgtgcggacgccgtaagcctccctgacgccctttaaggcatccagggtcactttcgctccttccggctccgaactgatggtcatggcaagcacgtcaatcacgatatctttcttgtctatcccgtactttccggcctcttcaatgatctttcctgctaccttgactcttccttctgctgtctggggaatgccctcctcgtcaatggtaaggccgattactacgccgccatacttccgaatcagcgggaatacctcatccatggattccttcttcccattgacagaatttaccataggctttccattgtagatccgcatggcagcttccatagcctttgcgtcaacggtatcaatctggagcggcaggctggtcacgctttggagctgtgtcactacctcctgcatcatggcagcctcgtcgatatccggcagccccacattcacgtctaatatgtgggcgcccttatcctgctgcatgattccttccttcaggatataatccaaatcatggtcctttagcgcctgcttgaacttcttctttccggtaggattgatccgctctccgatgatgactggcttctctcccagcacgaccgccttcccataagaggatacgatggtcaggtctttgcgagatgggggtacaacggacaatcctttcgtcctgccaatcatggcgcggatatgccctggcgttgtcccgcagcagcctccgatgacgcaggctcccatatggacaatcttctccatcgtctgggcgaactgttccggatccacgtcataatagacttgcccgttcctttgcttcggaagccccgcattgggcttgacaataacgggaagggacgtataggcaagaatctcttccagaatgggaagcatctgctctggccccattccgcagttgattccaagcgcgtccacccgaaggccttccagcagggcgaccacggatggcacatcgcctccggtcagaagtttgcccttctcgtcaaaaatcatcgttgcgaatacgggaagttccgtattttctttcgctgccagcacggccgccttaacctcgtaggtatcgctcatggtctcaatatggatcaggtcggctcccgcctcttccccatacttcattacttcccggaaggcttcataggcttcttcaaattccaagtctcccatgggttttaagagttttccagtgggccccacatccagcgccgtataagtcctcctgccagcgcctgctcccaggcaagcgcctttcttgacattttcgattgccgcattgacaatctcttttaaatcataggaggcatcgtggaacttcaatgcgttggcgccaaacgtattagccagcacgatatcgcttccagcctcaaaatactggcggtggatatccaccacctcgtccgcgtgctcgatattccatacttccggaagttcgccgggcttaagccccttggactgaagcaaagtgcccattcctccgtcaaaatatagtagttcttttcccagtcgttctaataacatctatctgctccttttgccctcttatcttctctgtctgtaaatactcttgtctcgtctatgaacatctccggtatacgcagtctgtcttttcacaggcctcgcatcctttgatatggcatggcgccttgatcctgctaaggccgatcaccgcagtcacagacttcatcggtgtcagcatgcctccggccgtcatcgtaagcccgatggtcttggcggcatccagcatccggaggatctcttcctgatgcccgatggagaagtcgccatacccggggctgaacctgggccttagataaaggccttctttcgccatctcttcttccatctttccctgccagtcatccaggtattcctccaggatcgtggtagcgcaggcctgcagcgtgactaccctcgccatatctgacagggcatgctttcgcatcagcagatccacctgggcgcccaaagttgcccccagaacgatcgccttctcgcatccgttcatattcttcctgagattcctgctttcaatgttcatctgtccgatctgtatgcagccgtcatcctggaaatccaagtcaaaaatgcgatagatgattcttctgcccgccgcctcttccagttccctgaaggaactttccaccagcgcaagcgtgtgatcatctaccgcatgccttccatatcccaagtaacgaactgcttccttcgtccttgtatccattttcttatcctctatgcctttataattgcagaaagattgcttatgatcgcctctgctacttccggcttattcatggagtaaatatgtatatggttcatcccatttgcgatcaggtcaatgatctgatctgtggcatatatgattcctgcctgcttcatcgcatccggatcctccccgaagcggtccaggatcgcgcggaatctctcaggcagcacggtaccggacagatcgcagatgcgcttcatctgctttgcgctggttaccggcatgatgcctggaagcactgggaccgtgatccctttttcccggattcggtataagaaattatacaggatattattgtcgaaaaacatctgtgtcgtgaggaaatccaccccgcagtccaccttgtgcttcagattcataatatcgtctttcttatgcgccgcctcaacatgtccttccggatagcatgccgctccaatgcagaaatccccctggctcttaatatcctctaccagctcgcaggcatatctgtaatggtttggcagagggaactccccgtccgccgggatatcgcccctgagcgccaggatattttcaatgccctgctctttcaactgtccgatcaccccgcgcacctcatccttggtggacgatacgcaggtaagatgggccaggcttgtaacgccaaggtcgttcttgatctgcgaggcgatccgaaccgtatttctgctggtgcctccgcccgctccataagtcacgcttatgaaagagggcctaagcgccgcgatcttctttgttgccgctctcactccttcatagccggcgtccgtcttgggcggaaatacctcgaaggatacatggggagagttatctttcagtatgtctcttatcttcatgtctatgctcctctttttcgtatctttctaatcccatgcttcttaaatgccatcgtataattcctcatattgctttgcggaattcttccatgagaaatcctgattcatgccgcgttccacaatcttgttccagtcacgcttcttatcatagtaaatgcgctctgcatagcggatcgttgccagcatctcatgggcattatagttcatgaagctgaatcccgtaccagtcttctcatattcattgtatggctctaccgtatccttgagtccgccggtctcccgaacgatcggcacggtgccgtagcgaaggctcatcagctggcttaagccgcaaggctcgaacagggacggcatcagaaacgcgtcgcaggaagcgtatatcttatgggacaaagcctctgaataatagatattcgccgataccttgcccggatatttccatgcaaaatgccggaacatattttcgtacttttcatctcctgttccaagcgccacgatctggaccgcatcctggcaaagttcatccatcacataggcgatcaggtcaaagcccttctgatctgtgagcctggacacgattcccagcatcatgatgtgatgatcctgctccaggttcaattccttttgaagcgcgatcttattctttatcttctccctccggaaactgtcagatgtgtagtttttctcgatgtgggtatccgtggcagggtcgtaatcttcatagtcaattccgttcacaattccggacaggcagttcgagcgggcattcataagcccctccagcttctccccgtagaacggcgtctttatctcttcggcataggagttgctcaccgtggtgatccggtccgcatacacgatgccgcccttcaggtaattggcatccttgtacgcttccagcttgtcaggcgcaaaataatattgcggaagtcccgtaatatctcttaccctcttggtatcccatgtcccctggaacttcaggttatgtatagtcatgatcgtcttgatcccccggtaatactcatccccatagcggaaattatccagatataccggaatcagccctgcctgccagtcatggcagtgaatgatgtccggccggaagccgatcaccggtagggcgctcaacaccgcttttgagaagaacgcgaacttctcgatatccgcgtacatatcgccatatggcgcaaatccgttaaaatagtattcattatctataaaatagaacgtaattccatcgtactctaattctagtattcctacgtattgttttctccaatttaaatccatataaaagtgcgtatggtaactcagtttttctttccattcttccttcatacacatgtacttaggcagcatcacccgtacatcatatttttctttgtcgaaatattttggtaaagaaccaacaacgtcggcaagtcctcctgtcttaataaacggaaccgcctccgaagccgcaaaaagtatttttttcattgcttttcctcccaacccttcaatatacacctattatagcgtattttttttaagaagaaaagtattatctgtttttatattccaatctgatcgtatctgcaatcaatgcgataaactccgaattcgtcggctttcccttgccattgctgaccgtgtatccgaacaggtcatccagggtatccagttttccacggctccaggccacctcgatggcatgcctgatggcccgctctaccctgcttgccgtagtctgatgcatctttgccaccgttggatagagtaccttcgtgatcgcattgagcacatccatgtcctccactgccatgataatggcatccctcaaatagtgatatcccttaatatgcgccggaatgccaatctcgtggatcatatccgtcacccggttctccagattcacctcgggcgcttcttccatcttaagcccctgggctgattgcgtcttcatctcatggcgtatcaggtgattggcgttcttgatccggttcaggaccatctcgttgttgaaaggcttcatgatataataactggcgcctttcctgaacgcatcttctgtgatccgctcctgcccgactgccgtgacgacaataaagtccggctgtttcttcaagtctttatcacctcctaccatttccatcacgcttaatccgtccatcttcggcataatcagatccagcagtacgacatccggctgcttttcttttatcagatggtacacatcctctccattgttcgcctttccgaccagatttaattctttatcgctgctgataatttcgccaagcaagtctagaattctctcattgtcgtcggctattgctacgtttatctctcccatttttacgtattgcctcccttccttacatgaaaaccgtcgagttaaattatataatttgacatattgcaaagcaagaaattgctgtcgtaaaaacttgacccgaatcgacaaatttatgacaaagtgacatttttcaacatattttcaataaaaatgccatatcccttcgtagagtcctggacaaatacatgcgtaaccgcgcccacgatttttccattctgcatgatcgggcttccgctcatgccttgtacgattccgcctgtaacttcaaggagtttcttgtccgtgacttctatgacgagccctttgttgatctcatccgtatgcttgtcgacttttgtaatacgaatctcataatccttcacttctccttcgacggcgcaacgaattgtcgcgggcccttcctcgatctcgtctgtggctgccgtctccataggcgtctggtctgtaaaaagcgcgtcaatgcggtcgatctttccaaagatgccgcagtccgtattcttggttatgcttccaagcacattataattgttatagacaatgattccttccatccctcccggcgtgccgttctctcccttctggatatctttgatgctggtctcgtacacggtgccgtcattgatctccagcagcgtattggtatccacatcatgaatcccatgtcccagcgccccgaactggctgtccgcattcaggaaggtaatggtgccaagtccctgggcattgtccctgacccagatccccagcttgtaatctttggagctgcatctgaccggctttagcttgatgtcgatcaaatcctctgagcggcgcaccttgagtaccacttcctctttgtcaatcttcttcattgcatccactaattgcgacttgctgctgatctcttcctcatccagggccacgatgtaatcccctgccttaaccaggtgggaggcaggctcatactccatgccgtccatggctgtcaccgcgtccgtgccaagcaccatgacgccctgggtctccaaatagatgccgatgggcatgcctccggggatcaccatatttccggacgatgtcccggcgcttacttcctggcgcagctggctgtgcttggattcaatcaggtagtagcctcctcccactgcaaccgtaaatgtaacgatcatgatcaagattctccggtaccagtatttcctcatgcttcaaaacctccaagaaaaagatagatacccattctcgggtatctatcttattatgtggcaattctctataaattactctggtttattttgtctgtttcgcaagttccttcatctccacggcgctttgtactaccgtatccgtaatttttgcgccgcccaggattcttgccagttcttcgatggaacgcttctcatccagcagttctatgctggtctttgtatcgcctttcttcgtagacttctctatcatgtagtgatggtctgccatggcagcgatctgggcaaggtgcgtgatgcagatgacctgatgcttctttccgataagtgccatcttttccgagactttctgcgcggtcctgccgctgatccctacatcaatctcatcaaagatcagcgtctcgatatcatcccgttttgccatcaccgtcttgatggccagcatgatgcgcgacagttctcctccgcttgccacgcctgccagcggcttcaccggctggcccggattcaaggaaatcatgaattcgatgtcatccatgccttcagccgtatagtccttcgtggattcaaactgtatccggaacttcacattttcaaaattcaggtctttgagcccctcttcaatcgcctcttccagtatcttggcctgtttcttccgaatcttcgtaagcctggccgtagactgtcttaacacctcttcggccttggcgcattggtctttcagccgcaggatataattgtcgaaatcttccagaatcccgatccgttcttcccggctggcacaataatccagtattttttctatcgtatctccatattttgtcttaagatggttaatttcattcagacggttttctgtctcatagaattcttcatcggaaaattcgcaggtcttgctgtaatcggcaagttcccggttgaagtcgttcagcaggctgtccacttccaccagctggccatagagctgcgcggccctgtcgtcatattcggatgcctcggataacgcgcggatggcacggcttaaggcctcgcttgcattgccgcctccctcgctggtataaagatacgcctcgtttacgctgtccgcgatcttcttgctgttcgtcatgcggcggtacagggattccagttcctcatcctccccgggaagcagatgcgcttcctgaatctcggacacctcgaactttaagaatgataattccttggcccgctgagattcgtccgcttcggcctctttcagttctttttcgcaggctttgtacgctttgtaagcctgtgctgccttctccttgtcttctgccagatattcctttgcaaacgcgtccacgatgccaagatgattcttcttatacagcagagactgatgctcatgctgcccatgaatatcaatcaaaatagatgacgcttccttaagaagccccatctgcaccgtctctccattgatcctgcttacgctcctgccggccatcagccgccttgagagcgtcaccattccttcttccggaaagatatccagttcttttaatttcttctgctggctttcattttccaccagaaatgtcagttccacgaatccatactccgcgccctggcgcaggatgtccttggtatagcgtccgccaagggcaaggcttatcgaacccaggataatggactttcctgccccggtctctccggtcaggatgttaagtccatccttgaattctacctcgatctcgtcgattaatgccagattcttcacatgtaaattctgtaacatactgcctcctacaagacaatcttgctaatcttatccattacctttaccgtatcgtccacgcttcggatggcacacatgatcgtatcatcgcccgcgatgcttcccactacttcattccactgcatggcatcgatcgccgcgcagactgccattgccattcccgctaccgtcttgatgaccagaatgttctgtgccatatccatagagacatagccatcccttaacacccggatatacttctcgctcatgccgttctccgcgctctgatgcaccgcatagcgctgcttcccgttctcataggggacttttgtaagttttaagtcccggatatccctggacactgtggcctgggttaccttgaagccttcctggttcaggtattcagccagttcttcctgcgtctcgatgtggtgcttattgatcagttcaataatctttgcgtgtctgtttactttcatgatgttaatttcctttcatctttctacgtagcgtttctaaaaagctgactttgcttaacttcattatcttggtggacgcctcagatctgcgcaccgttactttatcgcccgtggtcagtgccaccgtatccgcgccgtcaaaggtggtgaatacttcctccttagactcatggcgccccatgccaatctcgatcacgatctcatcatccgaagacagaacgatgctgcttgtattcagcgcatgggaacagatgggcgtgatcacgatcaaggatgccgtaggctccacgatcggcccgcctgccgacagattataagccgtggatccggtgggcgtggagatgataatgccatctgcctcataggagttgagcagttccccattcacatacagccggaaatgaatgacccgaagttcccctttcctggaaatcacgatatcatttagagacacatccttggaaccgtcctcaaagattccttccagcatcatccggtcctcaaatgtatagtcattgcttacaatctggccgatggcttcctcgatattgccaacttccacctcggtaagatagccaagggttcccatattgattcccagaatcggcacatcccgctcccacaaaatcctcgccacttcgatcaggcttccgtctccgccgataacgatggcgcattcgatatcctccggtatggcttcttttataatattcttcttttcatccttctggcataagacgcatttcttgccttctgtctccagaagttcctttaccttcctggtaatgatgtgatctgcatctttgccgtcattggtaacgattaaaaacctgtccatattgtcctgcattccttttaattttttgccagcgtgcaaaatgcctcttccactgtcttttcttcattgattccttctgctatcctggcatcctccccgcatttttccagatggatcagatattcgatattgccttccggtcctttgattggcgaaaactccagattcaggatggaaaatcctatggatagggcatactggattaccatagcgatgacttctatatgcgtgcgcttatcccgcaccacgcccttcttgccgactttttccctgcctgcctcgaactgcggcttgataagcgccacgatctggcccttctttgtgaggtaattatgaatcggcagcagcactttcgtaagcgagataaaggagacgtcgatggaagaaaaatctaccggctccccgatatcttccggggtcacataccggatgttggtcttttccatacagacgacccgctcatcctgcctcaatttccagtccagctggccccttcccacatctatggcatagaccttccgggccccattctgaagcatgcagtccgtgaatccccctgtggatgagccaacgtcggtgcatacttttccttccaccgtcacatcgaagttttgaagcgccttttccagtttcagccctccgcggcttacataaggaagtgtatgtcccctcacctcgatcgcggcttcctccggaaatgtggctccggccttgtcctccctctgcccgtcaacaaagacgctgcctgacattatgatcgccttggccttctccctggaagcagcaaggtttctttttaccagtaatatatccaaacgttctttcatattaactcctataatctgccatatgcgtcctttattcttcttgtaatggattccacgtcgatcccggtctccttacgcagcacgccgatatttccatgctcgacatagtcatccggcaaagccagcgtcaggactttcacgcccagatccttcctgcacgcatattccagtacatgctcgccgtatccgcctgtctgcacgttttcttccaccgtcacgatcagccggtggttccggcacaaggacgcgatcatcgcttcatcgataggctttacgaatctggcattggcgagagtacagctgtatccgctttccttcaggcgctctctcgcctgaagggcgctttcaaacatgtggccaacgctcaggatcgcaatatccttttcttcatagagcatctcgcttttgccgtatacgaccggcgcccggaattgcctgtacgcatcgaatgcgctccctcttggatagcggatcgccacaggcccatcataagacagggcaaagcgcagcatatccgccaattcccatttatgcttcggagtcataacgaccatattcggtatgctgctcagataagacaggtcaaaaattccttgatgggtctctccgtcgcttccgaccaggcctgcccggtctaccgcaagcacgaccggaagattctgaagcgctacatcatggatcagctggtcataggctctctgaaggaaggaagagtataccgcaaataccggcttcattcctcctgccgcaaggcctgccgcaaaggtcaccccatgctcctcggcgattcccacatcaaaaaaccggtccggatacatctgccggaatctggtaagccccgtgccgtctgccatggctgcggtaatggctacaatatccggattcctccccgcctcgtcgcacaggactttgccgaatacatccgtataagtatccttgtctttcggtgtttccagttcgcctgtctccacctggaacgggcctacgccgtgaaatttatccggcttaagttccgcaggctcgtagccttttcccttttttgtcattacatgaagcagcaccggaccattgatcttcctggcttctttaaatgccttgcaaagaagcccgatattgtgccccggtacaggtccaagataagtaattcccatatcctcaaaaaacattcccggaaccaccagctgcttgatgctgcttttggtcctgcggatatgctcgatcatggaatctcccactaagggaaccttctccagcgcattggtaacgccctttttcagccctgtatagatgtccgccgtgcgaagttctgccagatatttggacatgcctcctacattctctgagatcgacatatggttatcgttcaatacgataataaaattcgtcttaagagaagaggcattattaagggcttcataggccatgcctccggttaaagagccgtccccgatcacggaaatgacgctgtagccttctccttttagatccctggcccgcacgtagccaaggccagcggagatggaagtcgagctgtggcctgtatcaaacgcatcgcaggcgctttctttacgcttagggaatccgctcatcccgccgtatttgcgaagttcgtcaaatcctgccttcctgccggtcagcagtttatgagtataagcctgatggcccacatcccagatgatcttatcttccggaagatggaacatcagatgcatggccatggtaagttccaccacgcccagattggacgcaagatggccgccggtcttgctgatcttctcgatcaggaattcccggatctccaaagccagttcctccagttcctccaagttcagttccttaatatcattttccttctgtatacgctctaacataatcagttaccccgctatttctccctgtgaatcagctggagcagcagctgttccaggaattcattttctcctgataactgatgcaggaggcttaccgcctgatcggatagttcttctaccattctccctgcctcagcagtccccatcaaggtgacatacgtagtcttttcgttcttttcgtcgctgtgggtcggcttgccaagcacctccttggtgctggtcacatccaggatatcatcctggatctggaacgcgattcctacatatcttgcaatcttttctacgatctttacttcctcctcggaagcgcctcctaaaattgccccgatcatcatggatgcctcgatcagcgcggaagtctttaattcatagatcgtatccagcacttccttcggtatggaatgcccggtctctttaacgtcaatgacttgtcccccaatcattccgtagatgccggccttttcccccagcactcccagcgcccttccgatgagaagactctcttccggctccatgacaaacgccttgaaggccgtctcaaaggcatagttaagcagggcgtcgcctgccaggattcccatatcttccccatatacgatatgggtggtcttgcgtccgcggcgatattcgtcattatccatagccggcaagtcatcatggaccagggagtatgtatgaatcatctcgatggctgccatgaatgggcggatcagcgggccttccccgccgaacagccggtaagtctcattcataagcatcggacgcaggcgctttcccccagccataaggctgtagctcatagcctccatgatgacgctctggaatccttcctgcctgggcaggtactccgtaaggattccttcaatcttttccaccctatgcttcatctgtgtctgaaactgatacccattcgggcatcctgtattgccatcattcgataatgtatatttagaattcatgagcatctccctcttcatctaataccagcattttcttctctaccttatctatcttttcattgcacagcttcagcatatccattcccttgtggtacaggctgaaagaatcttccagggagatgtcttccttctccatcttgcggatcgcatcttccagctgcgcaaacagttcttccagggttttatcctcctgaatcttttcatccttatccatgctgctcctccttcacatcttccacagttgcctgtaggattccgtccgtcacatatatggacagcctgtcctgattctggacctgcctgatactcttgatggccttcttgtcttttccttccacgtaagcgtatccatggctgagtttctgaagcggcgacaggcccttcatcacttccacgtataacgccagcctgtgcctcgcatcccttaccttcccctccatcagcaccttcatcctgtcttccatctcagatagcctctgctgctgttcctgcagtttgagccggggatgaagatacttcaggcgggtatggcattccctaagtttcaggcgggatacctgtatcttctgattcagcagccggttcatccgaaggcggtactcctgcaaacgcatctgcacctgccggtaatcatagacggccagttccgcggctgccgacggcgtcggcgcccgcaggtcggccgcgtaatcggcaatggtggtgtccgtctcatgccccactgccgagattaccggaacgctgcattcgaagatcgcccgggccacttcctcttcgttaaaggcccacaggtcttcaatggagccgcctccgcgtcccacgatcatcacatccactccgtatgcttccagcatccggattccacgcacgatgctctccttggcgccttccccctgcacctgggccggataaagaatcagctggacatagggattgcggcgtccggcaatattcatgatgtccctcactgccgctccggtgggcgcggtgacaacgccaattctgcttgcaaaggatgggatcggctttttgtattccggtgcaaacatccccatctcttccagttcttttttcagcatctggaatttctcatagagaagcccatctccatccagccttatctctttggcatacagctggtaggagccgcttcgctcatacacatttacagagcccaggaccacgatctgctggccctcgctcatacgaaaagagagtccgcctcgctgcccggcaaacatgacgcaggcaatcgttccggactcatcttttaatgaaaaatatatatgtcccgatgtgtgatacttacaattagaaacctcgcccttgacgtagatgcggttcagcatgtagtcctgggtaaacatattcttaatgtaggcattcacctgttttaccgtatatacattccgagtcataacctacctctgattaatctacaagttttgcaagcacgccattgacaaaggaagggccgtcctcgctactatacttcttcgcaagttccacagcctcgtcgatggccacgcctgtaggaacatcctcgtcccatctcatctcatatactgccagcctcagaatcgtcagatccaccttgttcatccggctcgtcttccatctggtcgtatgctcgttaatcagcgcgtcaatctcttctaccttcgacgcgatcttctgtaccttctccctgatatagtcaaggtccttttcacccgcaccctccaactggccgaagtagagttccaactgctccggcatatcttcgccagcgttgaattccactccgaacagcatcttgaagatgtgctctctttgctctgtcctcttcacttatgcttcctccggcacgtctactccggcgatgcggatatttacatcggcaacgtcgaggcctgtcatattctcgattgccgcctttaccttctcctgcaccttcgtagtaatatctttgatactgtagccatacttcagattcagtgccagggacaccgtcacgatcccatccagcacatcaaccttgacgcctttggacaaagacttcatgcccagcttgccaatcagttcccttgtcgcgtttcccgccatggaagagacgccgtccacttccatcgcggcaaggcctgcaataatcgccactacttcatccgcaatcttcacctcgccgagattctcatcgccctttattgtatacgtatttctttcttctctactcattacctgaacctcctgtctggttttacacttctagtaattatatcaaatttacctacatttgcaaagtcttatctgccgaattcggataactcaagcccatcgttgcgctctatggtcatgcggatgctccattcattgatgaatagaagcagcggacgacccttcaagtctttcaccttcttcatgtcggatgtgcctgtcagcttatccaggtcaatctccgtattctcgatccagcggatatgctcgtatggaagagtgtccatgcgtatctccacattatactcgttttccagcctgtatttgagcacgtcaaactgcaggacgcccacgacgcccacaatgatctcttccattccggtgttgtattcctggaagatctggatcgcgccttcctgggcaatctgattgattcctttaatgaactgcttccgcttcatcgtatctacctggcgcactcttgcgaaatgctccggcgcgaatgtagggatgccttcgtagacgaatttgtcactggcattggtaagggtatccccgatcgagaagatgcccggatcaaagactccgataatgtctcctccataggctttctctatcatcttcctctcgcttgccatcatctgctgcggctgcgacaggcgtaccttcttgccgccctgtatatggaagacatccatgcctgcctcgaattcgccggaacagatacgcatgaaggcgatccggtcccggtgagccttattcatgttggcctgaatcttaaacacgaaggcagaaaagtcgctctcttccatgggatcgatcaggcccctgtcagactttcttggaagcggggacgaggtcatcttaaggaaatgttttagaaacgtttccacaccgaagttcgtaagggctgagccaaagaataccggcgagagttcgcccttgctcaccagttcctggtcaaactgcgccccggctccatcctgaagctcgatctcctcttccagctgcactctctgggagtcgctgataagccatgcgatctccggatcggcgatatctaccttcttcacctctccctgggtagttcccttgcgggtgtcagagaacagttctaccttcttcgtctccctgtcatagacccccttaaattccttgcctgagccgatcggccagtttaccgggcaggtggcgattcccagttcattctcgatatcatccagaagttcaaaggtatccattgcctccctgtccatcttattaataaaggtaaagatcgggatgtggcgcatggtacataccttgaaaagcttcctggtctgcgcctccacgcccttggacgcatcgatcaccatcaccgcggagtccgccgccatcagcgtacggtacgtatcctccgagaaatcctgatggcccggcgtatccaggatgttgatgcaatagccgtcataattaaactgaaggactgaggaggtgactgagatacctctttccttctcgatctccatccagtcggacaccgcatgcttagccgtggcctttcccttgacgcttcccgcctggttgatggctcccccgtacaggaggaacttctccgtaagcgtagtcttgccggcatccggatgggagatgatggcaaaggtccttctcttttttatctgctcttttacttcattatttatctgtgacatagattcaaactctcctacaaatagtatatccgcatatggacgctattagacagtataacacacctggaatcaatcctcaattgggaattttgtttattcgagggggaggatcggtgattggcgtgtaacgcgcggcggacgggtggcgggattcttgcgacgcttccggggctgcgactaatgcacggatctgtaagcgaagtgggagagtcgccgatagcggctcgtctcccacttcgcttacagatccggcatggattctccgccccttacgcttccctccagaatcccgccacccgtccgccgcgctcccgtcaatttactggctgtcctgggatgagtgcgggctttttcgtacaccattcgccggaacagataaaggccagcctatataagaagcataattgcctcctatcagactggcctgcaaactggtttatgcagttatgtataggccgcttcgctatcacatcgtccaacagcctcttctttcttcgtaaggcgtaccctatcgcacgcgccaccatccggattgccggagatgttagcctgcaaaagaggagccgctatcggcgactctttcgcgggcttacagatccgtgcaagagatgcaggcgccaaagcgtcgcaggaatcgccgccccagcctcgcgggcgggtcgccaatccccgaatccccctacttcccttcggaatacaccggcgtaatcacgatgttctgtgccgccacgcccgtcttgcgggtaatgatgtcttcgatctgcgcccggttggcatcgcttaattctgccgcattcacgactacgtctgccgcatcctgggtcaggcttaccacggcctcgctgaagcctttggaggccagaagggtctcggctgcggcttctttttctgcaatatccgtcattgccaccatctgatttaccgcgtcctgtttctgctcatcgcttaagttctcgttgtcgatgatttccatcagggactctttgttcttggctctaacttgctccctggtcacctttgcttctgcaactacggcgcttgcctcgccgcttgtaagtacagcctctcccggcgtcccgtccacgcttccatcgctgtcggtgccgtcctggctcttgatatcatcggacgcgcttgccgtcacgtcctcctcggatatgtccagaagttccttatttgcaagttctgcattcgtcttttctgccgtatccttatccccgaataattttccggagtaattcagatatcctgccgccgcaatcattacggccaatgctgcaataataatctggttctttttaaagattcgtttcactgttcatcctcctaccttgccacatcgtttatgaattcttcttcattatcctaatcttatgcgtgtctatcccaaataatgcttgaactgcttcagtaatattctgttttaccactgcattatctcctccggaggctatgactaccactccttctacctgaggactcagttccttgctgatataaggcgcctgtccctgggagccatctccgtcatatacggtggcctctccatggctgctgttctgtgtcgtgcgcgtccctccctggctgtcagactctgtaaccgtctcgctttgtgcctccacatccttctccaccactttctcggcggaggattgtaacgttatcatgacggttacgtccccgaccccggccatctgtgacagcacgccctcaaggtgcccttccatataagaagcgtaattgccatatgccgcctctcctccccccgctgccgccgtgctgctccttgcatctttggaagcagcatccttccccttccctgtgggaatggcgatcacgaccagcaagattcccaccagaagcagaatcaaaagctgatcctttttcaactttttaatcgaaaaattcttcggaatttcaaatcgtttctttttcttaacgtccaatctctatctcctccacctctatcccggttttctcatcttccggttcctgcacggcatcatccggatagccttctggcagcgtctcgccaagatacttggattcttcctctatctttttcatctgctcctggtactccttgctgttatacaggctcctcagcggatgctccatgccgaatatcttaagcaagggcgtggcaagcatgacgaccagcaccattccggtaaagaaccggatatacttcttataatccgaattcggaaggatatggatgaccgctgtaatcagcaccatataaaacgcaatattcttcatccattcatataaatattcaaacatagccccacctcagacatgactggttactgcagacacaatggcaatggtcagaaggaacagaaggcccgtagtaaataccacctgcataagaagctggcatccgtctcccaccgtctctacacagcctacgatacgcttgtcggatactggctgtataattgccgccgccagtttatataaaaaggcgatgcaggcaatctgcgccagcggcaccacgcaaagggcgatgcagataagagcccctgtcatcccgattccattcttcaccagcaccgccgtgccaagcgccacctccgccacgccgcctatggcgtccccgatgccgggaatggcttccgcgcctctggctatggcgcttcttttcactgaatcaatggccgggcttatcatcccctggatcacattcagcccgatgatgcaggccagcagcgtctttaatatccacgacaccgcaacctgtatcagttccgcgaacttacttagataatcctcagaggaaaggtaattcagcacccgtaccatcatatagatatggatcacgggcagaaggaaactggtgatcagaagttctacaagaaatattaaaaacagtaccagattataaaacgcgatggaagtaacgctgcctttcgcaatcgccactgccaggaaatacaaggggcagaatacgcccatgaaagaggtcaggctgtctatcccctggcttacccactccaccactatctggaatgaacttaatgccaatgcaatcagcagcagatacagggcataaaaactaatttccgatatctggcggctctggaatacgtttgagaaattgctgaatacggccgcaatgactgcgatcagaaggatatgtaccagattgtccttgcagcttccaaacgcatatcccagctgttccgttaccagccggttcagcagctgggcggaaaatgtcagatccccggaaatgactcccatcagcgtttccttaaagtccagcttttcttccgggaacaattcctttaaggaatcgtcaatttccccaaaatcgaactctccgatcaagtcctcctgcatcccggaactctctgccttatcctccttagttcccgactgcttggcctcttgggcctgtgccggcagcggagaaaatattaggagcaggatcacccacaggatggctgcctgtactatttttcgccgcctcatgacagaaattcctttatggtatttaaaagcgccatcagaaccggcatgcttaataccagaaccgccagtttgccgaatatctcgatctgcagcgcgatcgtctgatagcccgcgtccttgcagatgcccgcggagaattcggccacataggtaatccccagcatcttgatcagcgtaccgatataggcggtatccatattgatataattggcgatggtccgcaaggcatcgatgatcacttccagccgcccgatgatggcaaagaagatgaccaggctaagcgccacgctgatatagatgccatactcagactttccgcttttaaactgtacggccagcagggtgccggcgaccccgatgatcccgatctgtatcatattcatgggtattccttctttctacagcgaaaataaatgctggatggattcaaacaggtcatagatgtatggcacgatccagaacagcaccagcagaagtcccgcaaggcttgtaaggaatgcctgctcttcccttccgctgtgctttaagacctggcttaagacggagaccaggattcccaccgcagctattttaaatattagatttacactcatgcacgcctcctctatattaacaggacggtaataaatatcccgctcatcacgcccaggcagtggcataatctcacctttgccttcatcccgccccgcatctcttccatggaaaggctcatttcctccaggtagaggtcgagagtctttacctgcatctcgatatccgcgacccccagctggcctccaagatttatcagtttgtccagttcctcctccggaaggccggatgcccccagatattctcttgccgtatcttcccatatatcctccagcgtacccctgttcttatgctccagcctgtcgtatatttccagaagccatcctttatatggctccctggaagatgtcccaatatgacggaacgcttcccccagataagacctggcataccgtatctcgcttctcaactggtagaccagcttcttgagatactgcatctggacatactggtcgttgatacggtctgccgcccggatgccccataaagaggtggctcctatgatcaggacagccccgaaggtcttgaccatggccgtcatctggtatcttccctgtacagaaggctgccccggtgatcgaagatgccatcaatctgccctacgtgcccgcggtttcccagaaggatgtaccgttcaaagcgtccctgggcgatcatctggtcaaggagaggcttctttcttaattcttccatggagcctgcatggacagtggccagcatcttgcagccacagtgcattgcgtattcgatggcatgtacatcttctgccgagccaatctcatccacggcaatgacctccggccccatggagcgtatcagcatgatcatgccttccgccttggggcacccatccagcacgtccgtgcggattccaagatggttctgggcgacccccatatagcagcctccaatctccgacctctcatccaccactcccacagccatgcccctgacccagtcatttccatcggagatctgacggatcatatcccgaagaagcgttgtcttgccgcatcttggaggcgatatgaccagcgtatggtaaaggcttctgttattggcaatatagggaaatactttatctgcgcatccaagcacttcatgggacatccgcacattgacggatgagatatgcttcaggttctttactttgccgttctctatgattgcctgtcctgtcattcctaccctgtgtcctccttcaatcgtgataaacccctgcttcatttcttgctcgtatgcatataaggaataattgctgatatattccagcatctcccttacatcttcttttgtaaccatataaggcttgtcgcgctgcccgcccaggatcagttcctcgcccctgtagatcagaagcagcggcttttccacccgcagcttgatctcctgcagatactcatactgcagctgctccttatggagcagaatgcgcacgctgcgcggcaagacattcaagattctgttctcctgcatatttgtccacctctttacaccaatatatgagacgactttcaatttattcccaaatatgttacaatccgtatattcaagtatcagatttctacggaaaggatgaatttgctatgatcgctgtattgctcgcgcctgtctacctcctattgaatgcttatatcttccgctggctgatccgctatatgggagcctgcacgcatcattttaaaaagacttgggtcaggctgattgttctggccgtctacggctttttggccttatccatcctgctggcctttttctggcctgccagatggctgatctacctttcaaatatctggtttggcaccctctgctatattctgcttacggtcctggctgcagatggcatacgcctgattgcaaaactgatcgtcaagcgcgggaagaagcgggaatggaaggaatcccggaggctcttcgtcgccagcggcacgctctgcattgcactgatcctctccctgtccgtctatggctatctgaatgcccgccatatacataccacagattattccgtaaccattgacaagacttgcaaaaatctggattccatgagagtcgtcctgatagcggacctccacctgggctacagcgtgggaaatgcgcagatgtcccagatggttaaaaagatcaatgcccaggagccggatctggtggtaatcgcgggggacatcttcgacaataattacgatgccttgaaaaatccggataagatcgcccgcacgctgcgtggtattaaaagcaactacggcgtatatgcctgctacggcaatcacgatatccaggaaaagattctggctggcttcacgttcagccacgacaagaaaaaaatgagtgatcccagaatggatcagtttcttaaggatgcccatatccagtttctgcacgatgagggcgtcctgatcgatgactccttctatctctttggcagggctgacagggagcgccccggacgtggcatctccaagcgtttaagtccaaaggagctgacagaggatatggatcaggacaggccgatccttgtcatcgaccatgagccggatcagctgcaggagcttgccgatgcaggcgtagacctggatctgtgcggacacacccatgacggccagatgtttccgggcaatctgacgatcaagctgctctgggagaatccttgcggctatctgaaaaaagatcggatgcacaatatcgtcacctccggcgtgggcgtattcgggcctaatatgagggtgggaactaagagcgagatctgcgtgatagatgtggggtttcagtagaattattgggattggagggcgccagcgtgccggcaggaggcagttcctacgacgctctggcggcctgcatctcttgcactgatctgttaggctgcggaagagtcgccgatagcggctcctctcccacagcctaacatctcaggcaaggatattctggacgccgccgcttcccttcggaactgcctcctgctggcccgctggctgactgcaatccgatggtaattcttgatgggtgagacgctttattttattggcttatggcggggatttttatatatgcataaatttgtgaaggatggatttttatttttatgagtcatgtgttgatcgtggatgatgatgtttttattaatcgtatgcttgaggaggttcttgtgaaggagaattatcgggtttctcatgcttattcggggacagaggctttgcttttgctttcttcttgcaggccggatctgattcttcttgacctgatgcttccgggcttaagcggggaggatgtgctctcacagatatgcggcattcctgtaatcgtcatgagcgctaaggcagaggttggcagcaaggtctcacttcttcttggcggcgcggccgattatattaccaagccatttgatatcgaggaactgctggccaggatcaccgtccagtttcgcaaaacgtctgccggtgcatcttctgtcctgaagcatgatgatctttctttagacattgttacccgtacagttgccataggcgataagaatataaggcttaccaagacggaatttgcgatattaagacttttaatggagaatcctgcccaggtaatccccaagacggtcctccttgagcgcatcagcgaagacacgcctgactgcatggagagttccctgcgggtacatatcagcaatctgcggaagaagctgcgggacgtctcaggcaaggattacattgaagcggtttggggaattggctttaaaatggctgaagaataaaatatttactatttcttaacacttttcttaacagcttccttaactatcatcggttagaatagcagcatcaaataaaaggaggctttcatattatggaatacgctttgacagcaaatcatctgatgaaaaagtatgggcgttccaacgcgctggacaatttttccatgcaggttcccaaaggagcaatctatgggtttgtaggaaagaacggggcaggcaagacgacgctgatccgtctggcctgcgggcttcaatcaccaacgtccgggacctttacgctatatggggtcaaaaatacccagaagggaatccggaaagcacgccgcagaatgggggccgtcgtagaagccccttcgatctatctggatctgtctgccgcggataatctgaaacagcagtaccatgtactgggacttccctcgttcgatggcatcccggaactgctgaaattaaccggtcttaatgataccgggaagaaaaaggcgaaagatttttcccttggcatgcgccagcggcttggaatcgccatcgccttggctggcaggccggatctgcttattctggatgagccggccaatggcctggatccacagggaatcatcgagatccgggaactgatccttaggctgaaccgggagcagcagatcacggtattgatttcaagccatatcctggacgaactttcacgccttgctacccattatggcttcatagataagggacatatggtgaaggaaatgacggccaaagaactgaaggccgcctgtcggaaatgtacccggctaacggtaactgccaccgccatccttgtccgcacgctggacaggatgggcctggattatgaggtcatatcggatacgcagacggatatttatggagaatttcctgtcacggaactgactttggctttggcaaaggagcactgcagcatactgtccctgcatgagcatgacgaatcactggaaaactattatattaatctggtgggaggtgacaagtatgaataagcttttacgcgcaaattttgcccgcctctggaaaaaccgtccatttctagtcggcctggcatttatgttcctggccggaagcgcatatgtcttaaagcaataccagcaaatcaaggtataccagattcccgtaagcctggaatctacatttttcacttacgcgatgctgatcggcgtccttagcgccatcttctgctctctgttcctgggggtagaatacggggacggaaccatgcgaaataagatcatcgccggacacaaaagaacggatatctacctttccaatctgatcaccaatctatccgcttcccttctcatgtgcctgtcatacatcttgtcaaacgtggttcttggcattcctctgctgggatttcagaaggccagcctctctgatatactgctattgatatcgggaagctgcgtcacggtggctgcgctttgctcggtcttcactatgatcagccttctgattcagaacaaggctctggcgcctatcgtctgcattgtaggaatgtttctgatgctgggcgccgtatcagagattaagcggatgctggaccagccagagtattactatgacaatgtaaaaaataaaaattacctggatggggagatccgtgagaaattcgaattctgttataattttctgccagccggacaggaaatgcagtacgcagccatgaaaactgagaacattggcgagatgtgcctgtattctcttggcatcacggctgtcataacaggtatcggaaccttcttcttccgaaaaaaggatataaaataagcaaagaggtattggcatgaatatttggatctgtctattatgggctgcacttatcatcatcgttatactattggtcaaactccatcttcttagaaaggccgcacaggagatccgggtggcggtctgcgaaaaactaaaggaagagacgaacacattgattgacatttccagccatgacgcccagatgcgcctgctggccgactgcctcaaccagcagttaaaggaactcaacgccagaaggcagcgctatgagcaaggcgacctggaactgaaggaggctatcttgaatgtgtcccatgaccttcgaaccccattgacagccatctctggatatctgcaattgctaaagcaggaggaatgctcggaaaatgccggagactacctcgccattatcgagaatcgtacagcggcgctgcgttctctcacagaagaactcttccgctatacgattgctgtctcggatgccgaagccctcacgctggaggaggtttccatcaatagcgcgctggaggccagcatcgcttcttactatggagccttaagccagaaaggaatcacgccaaagatatctttgccggaaaaaccagtcatgcggaccctgaacaaggacgctttatcccggatcttcggcaatattatctccaacgcgatcaagtatagcgacggggatctgcgtgttacgctgacggaagccggagaggccatatttacaaaccatgcgtctgccatgaccgaaacgcaggtaggcaagctcttcaaccgcttttacacggtaaataccgcccagcattccaccggccttggactttctatcgcaaaggcgcttacggaacggatgggaggaacggtgaccgcaaattgtaaagacaatcttctaagcatccatgtgatctttccagattaaaaaggctgcgattcatcctcctggcgttttcctcaagccaggaggatgaatcgcagccttatcaaattttctacagttccagcaggccgctgatgtccttgatcacatggtctgctcctgcttctttatatatgtcggtaactctctggcattctgccattcgctttgcaggcgtaagggattcatactcttccttcgtataccccatcaccgagcttccctcaatcacgcccaccgtgataacgccggcattcactccttctttgatatccgcaacggtgtcgcctactttgatgaccttccgaacggaagtgacgcccagtgcctccatattgcggaacatcatataggggtatggacggcccacattgccgacggcgttcgggctgacccacagatccggcgcatagccgttctcttcggcaatgggggctacaatgttcatcatctcatccgtataccctgtggtggagcctatcttgattccctgatcccgcagctcgctaaccgtctctatcacatggggcttgatatctacaaatttggggagaatctcaagcgtcttcgcctccatgatgtggtaaatgtcatttacatcctcttcattccacgctctacccgtcgttcttttccacaggccatcgatccgatccatctgcatcatggtacggatatggtcgatcttcagcattcccataggttttcttacttcttccatagtcggctcgattccaaaactcttaaatgcctctacaaaggcctgtaccggagcaaagcatccatagtccaccgtcgtgcccgcccagtcaaagattactgcttctatacgtctcatctggcacctcctaatgttctgcgaagaactctttcaatatatccgcaagttttaaaatatcctcttgatagacctctccgatattgccgatgcggaaggtatcggcctgcgtcaccttgcccggatagatggcatatcctctctccttgatatagtcatacatttcctggaaggaaaaatcatggcggtctggatagaaaaaggtggtgatgatcgggccctgatgcgcggcgtctatgtatgggcggattccaagttcttccatcttctcgatcagcagctggttattctctcggtagcgtttttcccttgccgggattccgccttccttcttaagttcccggagggcctgggcaaaagcaagcaccacatgggttggcgacgtaaacctccatttcccgtccacatgcatcgtcttccactgatcatacagatccagcgagagacttctcgcctttcccgcgctggcgatcagatccgcccgattacagatgatgaaagagaatcccggaactccctgtatgcacttattcgcgctgcttacgaggtagtcgatccccagtttctggacctcgatatccacgccgccaaaactggacatagcatctacgataaagattttcccggctcttttcactacctccgccacggaagcgatatcattgaggatccctgacgtggtctcgctatgtaccatagccacatgggtgatggatggatcctcccgcagatactcttctatcttcccggcggaaggcatcctgtcataatgctcatgataagcagtgtaagaaagctgattgtgcctggcaatatcctccatcctctctccgtatgctccgttggccgcaatcagcagtttgtcatcttctccgataacactggataatacggactccactccgaacgtcccgcttccctgcatcaggacgaccgtatatatctcatgatctacatgggcaagatcaagaagttcctccctgatctgctgggtaatcttcttataatcgtcatcccaggtgcagtggtcgaacagcatttcttctttcaccgtatccgtagtcgtaagcggccccggagtaagtagtttataattcttcactttccaaaacctcctttttatttgcactcttctgaaagtgcctggtgcttttccagcagttttacagatagtttttccgggaaggccttcggattgcctgacttattggcatcatccaccttttcgccttcatatagaggaatcggatatgtcttaagcaattcctctctgccgttagcgatgatgcactccgccatcttcatggcctcctcattcttttcatccttattattgactactgccacagattctgtcaatgtaaaatttccttcttctggatccacataatcaatcgggagtccttcttccttatccgcaaccgcctgatgcctcaggccaaatccaattgccacttccccggctcttaccttcttaatggggccagatccggaatcctcgatgtgggcgcctgcattttcataaatatccgccaggatatcctttgcctcttcctccccatattcgcaaaccagcgcctggatcagaagccatgcggtggaggaactctggatgtccgtcaccgatatcatgtccttgtagacgggatctgccaggtccttgatggatgccggcactggaaggctattctccttcaccatctccgtgttatagataatcgccccttcctgggcagtgattggcgtataataagacggatattcatccagcgcgcctgtctcaaattctaaatcctgaaacatcggatgctcttcctgcgcgctttccaggtaaaaagaactcatggtaaccaggtctgcctcgatatcggccccttctgccagaagcttgcctccaagttccgatgttccaaaggtctgcacgatgtatttcccatcatacccattggagtcgagcgcgttcttcatggcctccaccgcctcgtcgtccgcattggtatatagtattacctgttccccggctgtgttaccgctgccggcacagcccgtcagcgcgctgcctgcaagcagcgtaaaagccattcccacaaatgccgctttttttatttttctcatccttcttttatctcctttactttctctccattttctatctgccaggagcgtaagcagcagcttcccggccagattcgtaaataatatcagcagtgacagcacaaagatctcattgaacttcgcaaagtgctgcagttccttaatcttcgtcgtaataaccatggtccttgcccccgccaggaagatgatggcactgaccgtcaccatggcattcacaaaatagtagctgaatacttccagaagggatgacgccgcattgggcgttactacccttgccagcgtcttgatccagctgtcccccatcagccttgccgtcttctcccaggacaggttcatcttcgccagagaattcttcatcatcatgtatggggtagcgaagaaatgcaccagattacagatgatgatcagggcaaacgtattctgaagtccggtccctgtaaaggccagcatgaacgcgattcctaagaccattcccggaatcgtattcgtgatggatgcgatgccctcgatgatgttcttcgcccggttgtccatgctgcttctcgccgtaacgatcgcagccccataagccatgatagtaccgagggctgccgtcaggattgccgtaagaagcgaattcttatacaccattgtaagcgatgggtccgcaagcgcatttcttacatgctccatggtaaaacgcatctcatagggccaccctttgacaaaaggcacgatgaagatcaccgcgaatatggccaggactcccagaagaatcagcgccgtcagaatcgcgcagatgacatcccgcatccggctcttcttattctccatctgcgtaatcttactgtaccgtacgttgtatctctctaaatacgcgactacggatatactgacgatggagggcagcagcatgatgaccgccacaacggctccattgttaaagtccggcacgcttccaagcatctgggcgtagagaaccgaagcgatgacttccactctgcctcctacggatgctggtatgccaaagtcggtaaagcacaggaagaagcattggataaatgataccgccagcgttcctgccagcgggcgcagcagcgtttccctgaatgtcccccaagcgctgtctttcataactctggataccaccatgaatttcttgtcgatgtatcccatggtattgttgattagcataaatgagattggaagcgtatagatgacatagccgatcaataggccgcagattccatagatatcaaaggcctgcctgccaagtaatctagtgaaaagcccctgctttccgaacgaatagataatcgcgaatccataagtgatcgtaggcagaagcatcggcagcagggccagcgttttaagcgtcttcttgtatccgttcccgacgttggtataattgaccgtataggccatgatgaacgcaaggcctgtggctatggccgctcccagcgctgatatagccagactgttgcgaagcgcctttaagaatccttttgcagcaaagatctctttatagttcgccagggagatgcccccatccgcctgaaaggatttcagcagaagcagtatgagcgggaatgccagaaataccataaaaatgagcatgatcaccgtccatacagcccttgcctccgtattcttctttgccatctagcccacctgccatgtctgtcttagaggtctttccttgctaaacagggagaagatattgttcttctttacctccagctgcttcagaataaattcttttacaaaccggttgcccggagcttcgataatctcctctggccgcccatactgggaaatgctgccctcattgatgatcagcacccggtcggataaggtcagcgcctcttcgggatcatgggtgacgatgatcgttgtcaggctgtattcttttgcgatcatcttaatcctgtccttaatagactctttgatgacgccgtccagggcgctgagcggctcatccagaagcaggatcttcggcttcatgaccatggttcttgcaagcgccaccctctgcttctggcctcctgagagctggtcaatcttcttgtccagatgttcttccaggcccagcaggctgatcagttcttctacttcttccccggtagatatatccggcttatttctcagcccataggtaatatttttataggcattcagatgcgggaacaaggcatagtcctgaaatacgatattgaatcccctttcttccataggcacatccgtcaaatcttttccttcaaaaataatcctgccgctatctgtctgcgtaagccccaggatcaagttaagcagcgtcgtctttccgcttccggagggtcccaggatggatacgatctcgcctttttcaatctccaggctgatatccttcaggatggatactccgtcaaatgatttactgattttttctaatttcaacattgcggaaactcctttctctttcattcttctgttcgaacaagactactttaactatttcgagcttcaaaaacaacaaaatccaggtaaaacttatgtaaagccgtatccaagcggctcctgccgtccttttgcccttgcgcaaaaaggccttccgccaggaaaatccattcgattctccggcggaaagcctctttttatctcttattatattgttctatttttgttcgctttggccttaaaacatttcctatgacttattgtaagccgatattttaccaaaaattattcttttatatcttacttgcgtgtatttttctcctatctgtacaaattcacttaatattctttttctatctcctgtaccatctgatagagtctttcatttgcagggaccggtatctgatgtttctttccgagttcaatcaccgtgcccgcaaacatctctacctcggagtgcctcctggatacccggtcctgagccatagatggaatgccctcaggatccagcgtctcaagcagccctacataataatcccggtccgccccggtaagcgcgatgccttccgcatttccaagcgcgatcacctcttccatggctgcgatcatcgtatcatgtgcctcgccttcccgaagaacgcccgcatagttggttccataagtcatgcaagtctggtttacgcctacattcagcatgaacttgccccagatgcgatgcatgatgtctgcgtctttctgataaggcatctggatctcgtcgaagtactttgatactgcctctacattcttctcctgctgtggcagttttgctccgatgcgcagttctcccatctgcgtatacttaagctcgttgccgaacttcatggcatccatcccctgagccaccgtgtagatcatcttgtctgctccatactgcgctgcaatccggtcttcactgctgatgccgttcatcaccgacataataatggtgccatctcccacgcaatgcctcatggtctctatcgcagaagcaaggccattgtattttaccgccacgatcacaagatccgccttttccgccttctcgctatcctccatacaaaacgtctgctcctttttgttgcataaaaacacctggccttcatacctttcaagcctggaactatccatcacaaaacatacggcatcctcgcctgcgcgctcctttatgtaattcgcgtacatcactccgagcgctcccattccgataatcttaaccttcatatgacatcctcctttatgtttgattcatttttgcacgggtatttttcaattttgcacaccagttatgtaagttgagcacgtaacatttttgaaaaatgttacgtgctcaacttaaaaatgttacgtgttcttttttattttgccacgtctttcatgctgaaggacagtctgcccattttgtctttgccaaggcataccaccttaactacatcgccaagcgtcagcacgtcttctacatggttgattctttccttcgatatcttggaaatgtgtaccattccttcttttccaggcgcgaactccaggaatgcgccgaattccttgatgcttacgacctttccttccagtacctggcctgcctcgaaatcggtcacgatgatctggaccagtttctttgcctcttccatgctgtcagcatcggttccgcagatagatacggctccgtcatcggtaatatcgatcttgactccggtctggtcaatgattgcattaatcgtttttccgcgttgtcccactacatctccgatcttctgtggatcgatctgcatctggatgatcttcggagcatactggcctacttccggtcttggctctgcgatggtcttggacattacttcatccaggatgtaggttcttgctttcttcgttgccgcaatcgcttcctcgataatcggccttgtcaggccatgaatcttgatatccatctggatggctgtgattcccttatgagttccagccaccttgaagtccatgtctccaaagaagtcttccaggccctggatgtctgtcagtaccagataatcatcgtctgaatcgcccgtcaccagtcctgctgagattcctgccactgcggccttgatcggcacgccggctgccattaaggacattgaggatgcgcagatgctggcctgggatgtagagccgttggattcaaatgtctcggatacggtacggatcgcatatgggaattccgcctcacttggaagtaccggtatcaatgcgcgctctgccaatgcgccatgtccgatctcccgtcgtcccgggcctctagacggccttgtctctcctacggagtaagacgggaagttatagtgatgcatatatctcttagaagtctccgcctcatccaggccatccagcctctgagcctctgcaagcggagccagggtggtgatggtgcagatctgagtctgtcctcttgtaaacatagctgagccgtgaacccttggaatcaggtcaatctctgcagcaagtggcctgatctggtcgatggcccttccgtccggacgcttctgatcctttaagatcatcttgcgtaccgtcttcttctggtactggtatacagcctctccaagcacattcagccattcttcattgtctgcaaatgcctcttcaagttttgccgtgatcacgcggatattttcttctctggtctgcttgtcatccgtaaatacggcttcttccatctcagacggaggaacaatctccttgattgcggcaaacagttcttctggaaccgcacagctttcatatgtgtgcttcggctttccgcactctgccacgatcgtctcgatgaacgcgatgaccttctggttcagctcatgggcagcaaagatcgcgtcgatcatcttctgctccggcacttcattggcgccagcctcgatcatgatcaccttctcttttgtagaggcaaccgtgagcgcaagatcggaagcttccttctgcgctgcagtcggattaaatacgaactcatcatccaccatgcctacctgggtcgtagagatcggtccgtcaaatggaatatcggatatggtagtggcaattgccgctccgagcattgccgtgagttccggagagcagtcctggtctacggataataccaggttctctaatgtcacgtcattgcggtagtccttcgggaataaaggcctcatcggacggtcaatgacacggcaggtaagagttgcattctcagatgcctttccctctctcttgttgaaccctcccggaatctttcctacggaatataatctctcattatattcaacgctgagcgggaaaaagtcgattccctctctcggcttctcggaagccgttgccgtacataacacggtggtgtcgccgtaatgcatcaataccgcgccatttgcctgcttggcaaccctgtccacatctacgcgcagagtcctgcccgcaagttccatctcaaatttcttatacatagtgttctcctttaattcttgaaattacctgggagaggaacaccgaaactactgaaaaatatacttatccggctatccaccagggcaaatatgcttttcagtggtctcgggtgtaatttcctcacccatagtcttaaatattataacatatatgataaaaatgtgccaccattaaattaaaagaggcgttcttttgaacgccccttcctatcactgcatgaaattattttcttaatccaagtttttcaatcagtgcacgatatcttgcgatatcagacttcttaagatatgccagaagacctcttctctgtccaaccatcttcagaagacctcttcttgaatgatgatccttcggattgctcttgaagtgatctgtcagatcattgattcttgctgtcaggattgcaatctgaacttccggtgaccctgtatctccaggtgtccttccgaaatcttttacaatctgttctttctgctcttttgaaatcattgtcatttcctcctataattctttattaaacgcctgatattaagcaatggttggagattccatttaccgaacaccggctattcatacccaattagtatagcacagcagccttgtcttgtaaaggcaaaaattattcctcgtcctcatcttccatgccctcgtcaggctccaggatagcaaacgcgatgttggtggcatgatccgccacacgttccagtccggagatggtatctgaaaatatcattcccgcttctggcgtgcatttattcttcgtcagcctcttgacatgcgcgcgctgcagcttcttctccctgtcatcgatctcgtcttccagattcaggatctcctgcatatgctcctggttcctgttggagaacatatccagcgagtattccagaatctcaatgaccttttccgtcatgtcctgcagctgctttattgccttgtcgctgaactccaccccatcatcaatccgcatttttgccgaatccgcaaagttctccgcatggtcgccgatacgctcgatatcattgaccacatggaacagcccgccaatcagtcttgcgtcggcaatcggaagctcgatttcattgaccttcaccagataatccgtaatcttgcggttcatgaagtcgatgtatttttccttgtggtataccgcatcgatttcttcctcattcaagctgcaaagcgcatccataccctttttcagattgccgatggcgatctttcccatgtgctcgatttcccggattccatccagcactgccgttgtcggcgacaggatcgagcccccgcctatgtagagcagttcgtactcgtcctccggcgtggcgtcttttccgggaaccaccatgtaggttgccttgacgatccatcccatgaacgggaacagtacgaccacttcgaacaccttcataagcgtatgggcattggccaccgcccgggccgtatttcctccggacaggtgcaggatgccctgggtgatcggatccagcgctaccatcagaataatgaaggcaatagccgatcctacgacattaaacagaaaatgaatcatggccgcgcgttttgcatccttctttccgccaagactggcaagaagcgcagatacgcaggacccgatattacatcccaggatcaggaacgggcagattgcaaatgccagcagtccctgggatgccatcaggattacgatgccgacggttgctgaagaactctgcaggatcgccgtaatcacgaatcccaccaggatcgccgcaaatggattgcgcagcgtccgcagcagttctacaatgtgcggggattctttgatcgatgtcatggcatctcccatgatgctcagtcccataaacaggataccgaatcccagcacgacttctcctgccctcttgatgctcagtttcttgcagaacatgaccatgatcacgcccgccatgacgaacagcggcgcgatatccgacaggttgaatgcgatcagctgccctgtcaccgtggtaccgatattggctccgagtatgaccccggaagcctgaagcagattcatcagcccggaattaacaaaactgactaccatgaccgtagtcgcgcttgaagactgcaccacggctgtaaacaagatacctaccagcatgccgataaaccggttcttcgtgaaaaattccagaatgccgcgcatcttggcgccggcagctttctccagcccttcgctcatcagcttcatgccaaacaggaataagcctagtcccccaagcaacataaaaaatgttgtgatactcattcgtattctcctttacttatccatcccgaagaaatgctttcccgcttcgatgtccctgtcaatacatgccttcatctcttcaatactgtcaaacttttgttccggcctgcacatggaaagcagttcaatggtcacttcttttccataagcgcttcctgcatagccaaataaaaaactctctatcagcagccgattctcactggtcaccgtaggcttcacccctacattggcgattccgtgatatctggtcccgtctacagccacatcgcaaaggtatacgccgttgggcggcgcgatcttcgctttgggccaggccacattaaaagtaggaaatcctagcgtccttcccagtttctttccatgctccacgattccggtcaggccgtaaggatagcccagcagccgaaaagccagcttcatgtctcccgtccttaacacttcttttacataagtactgctgataatacggtcttcatatcgttctttctccactaccaccagttcatatccgcactctttttcataggctgcaagcatgtgaatatctccttgcttgtcatgcccgaagcagaagtcggttcctactaccacataatccgcgtgaaaaagtcctttgatgatatccttaataaattcttctgccgggatctggctgaactctctggtaaaagggcattcgatcagataatccacctgcccctccagatgcatctgccgctctttgtcattcatcagaacttgcggattcaggcccttttcttcccacagaggccgcatgtcgaacgcgcatactatactgttgatcttatccttttctccatattcccgtaccttcttcaccagtttctggtggcccttatgcaggccgtcaaactttccaaacgtaactgctgatttcccgctgtcattatagttagacagtcctctaatatattgcatacttgtccctcttaaccgttagatatattcgttaaaaaacatctttacgatgtgatattcttttctctcttccttccaggcgtagattgcgataaactgtccagcctcgttatacagcctcacgtcttccccgtctgctatcccttcccctccagtcaccgccttcggaggcagggaatttccatttctggccagggatatccacggctcctttactacaatcttccgatatccgccaaacatggcatctaccggcaccaggacttcccctagcgttccttcctgcatcctcttatggatgtccgcaagcgtcagactgtctgacaagagaaaactgctgacttttgtacggaccagttcctccatacagccgccgcagcctagcttttcaccgatatcatggcatagtgtacggatataagtccctttggaacaggagacttccatccataccctgggaagatccatcttaagcacgcgaatctggtaaatgtccaccgggcgtgcctttcgctccaccaccttgccttctcttgcaagttcatataatctcttcccgcctactttcagcgccgaatacatcggcggaacctggctgtatcctcccacgaagctttggattgcctcccggacctcttcttcgccaatgcctgctgtatcggccgttccaagaacctcgccccctgcatcctgcgtatcggtagatacgcccagcagaagaacggcttcataggtcttgtccttatccgtcagcatatcgcacaatttcgtggcttttcccagacataccggcaggacgccggtagcatccgggtccagcgtgcccgtatgcccgatcttcttctgccctgtgattcctctgagtttcgccacaacgtcatgggatgtataccctttttccttatacacatttaacacgccgtgtatcatatagttctcccatcctatttatctaatgtagtttcaatctgaagttcaatctgccttgccagattgcaaagcacatcgtggggcgttcctgtcatcgtaagtcctgccgccttcttgtggccgccgccgccaaagtactgtgctactttgcttacatccacgtcatacttggagcgcaggctgactttatatacattggtctccagttcgtacataaagatcgccacttccacgcctttcgtaacacgcagctggcttaccaccccgtccagatccttgggatctacgccatagaagtccatggtgttccttgtgatataggatgcaatgcatctgccttccatgaatagaatgctttccagcaatgccctgccaagaatctggttctgggcataggtcttctcgtaatacgtatcctggatgatacgcggcgcatccacgcccttttccagcagttttgccgctgcccggaatgtagaagggcccgcgcaggaatactggaacactccagtatcatgcacgattccaagatacagggcctctgccaccccaagcgtaatcttctcttcatccagcagattatagatcaattccgatgtggaactggcatccggcacgatataattaaagtcggcaaattccgtattgctgatatgatggtcgatacagcaggttcgtactgcctgctcaagcagcaaagccgagaatccaagccgttccttgtcgccgcagtccaggcagatgaacaaatcatattttgtattttccggcagttcatgcttaatgtcttttgtggcctctatgcaccggtaggcctgcggtatctcctccagatagacgtctatgcgcctgtccttataattctccttaaggtactgataaagccccatgcaggagcctacgcagtccccatccggacgcacgtggccgccaatcgcaatgcgagaggcctcgccaagaatattattcagcatctgcatcaccctctgattttaatccctttgtcacttcgtcgatcttcttggacatatttactccatattcaatcgactgatccagcacgaaccgaatctccggcgtattgcgcagattcagcgtgcgtgccagttcccgtcggatatatccctccgcgctctgcagccctttaatggtctcttcctgctcatgcgcatcgcccagcacgctgatataagccttgcaggtcttcaaatccggagccacttctgctgcgaccacggaagtccagggcgctacgcgcggatctttgattccgcctcttatgatattgctcagttcccgctgcacttctgtgctgactcttgtattctttatgcttctttttctcattttactccctcttttccgcagggagacggccagatccccatattatctgggaatctcgaccatcttgaatgcttcgacgatgtcgccttcctttacatcattaaagttggcaaatacaaatccgcattcatatcctgctctaacctcttttacatcatctttaaagcgcttcagagatgccagaggaccttcgaatatgacgattccatcccttgtaatgcggacagagcagtctctttcaaacgtgccatcctggacataggaaccggctatggttcccactccggaagccttgaagatctggcggacttccgcgtggcccagaaccttttcttcaaagactggatccagcattcccttcatcgctgcttctacatcttcaatcgcgttatagattacgcggtacaggcgaaggtctacgccctcgcggtccgcagtctcctttgccgtagcatccgggcggacattgaatccgataatgatggcgttggatgcggaagccaggcttacgtccgactcattgatcgcgcctacgccgccatggatgatcttaactacgacttcatcgttggacagtttcagaaggctctgcttgatcgcctctacggagccttgaacatctgcttttacaacgatgccaagttcttttaaattgccctcctggatctgggtaaacagatcatccagggacaatttggatttggtatcttccagcagttttaccttgctctgagagataaatgtctccgcaaagcttcttgcttctttatcatttgcacatcccacgaatacctctcctgcatttggaacgtcattaaggccaaggatttccactggcatggatggtccggcttccttcacgcgccttcccttgtcatccatcatggcccttaccttgccgtgggcggagcctgccgcgatggaatcgccgactcttaaggttcctttttgtaccagaactgtggctacagagcctcttcctttatccagttcggcttccaggacaagtccccttgcgcggcggttcggattggctttcaattccataacctcggcagtaaggacgatcatttccatcagatcctccaggccttctcctgtcttggcagataccggaacaaagatggtgctgccgccccagtcctctggaatcagctcgtactcggtcaattcctgttttacgcggtcgatgttcgcgcttggcttatcaatcttattaacggcaaccacgatctctacgccagcagcctttgcatggttgatggcctctaccgtctgcggcattacgccatcgtccgcggcaactacaagaatcgcgatatccgtggagcttgcgccacgcatacgcatagccgtgaacgcctcatgtcccggcgtatccaaaaacgtgatcttttctccgtttacttctactacatatgctccaatgtgctgcgtaattccgccggcttccctgtcgattacattggtatggcggatcgcatccagaagggaggtcttgccgtggtcaacgtggcccatgacgcagactaccggaggacgcttcttcatcttcttctcatcctcttcttcttccttcagaagttcttcaattacgtctataacttcttccttttcgcagaggacatcgaactccagcgcgatctcttctgcggtctcataatcaatctcctgattcaccgtaacgattttgccctgtaagaacaatttctttacaatcacggaaggaacgatcttcatcttatctgccaactcctgaatcgtaagtacttccggaataatgatcgacttaatctgctcttccactttctgctctctttgctgcggcttctgaagcggctgctttggctcgttctttttcttgccctttccaagcccgtcttcttccccgcggcggtactccttcttcttatgatcatctttgccctttaccttgctgcgctgcggcttctgtgccggtgtctcaggcgctggaatggcatcattgcttctcctgtcgttattgcgcctgtccggcctttcgcctggcttgcggctctggtttctgtcgccttgcggacgatcctggcgatttccctgtggacggcctccctgctgcgggcggcttccctgcgggcgatcctggcgattcccctgtgggcggcctccctgctgcgggcggcttccctgcgggcgatcctggcgattcccggaagttcctctggaatcctgacggcggtcatcgcttctttcctggcgtcttggcgcctggcttctgtctgttgccggtctctctgcctgcctctcctgtgtctggactctttcctggcttgcggcagctggacgtcttgcctgctcgaaggacttatctgccgttctctcttgcggccttgcctgctgggtaggctcttgggctggcgctgccggacgggcctgctgttttgcagggcgtccattattgacctgcattggccttccctgctgcggtgtctgacggttgggctgcgggcgtccctgtccttgcggccttctgccctgctttgcgccattctgggtattctggggccggaatacgtgaacaatgttcttctttttcggcgcctcggcctccggcttcgctgctgcatccttattgccttttgtcaaggcctttcttgccatatcggcatctgcatcctccagggaactcatgtggttctttacttctatattctttccaccaaggaattcgatgacttccttgcttggaacgtccaactcctttgctaattcatatactttgatttttgacatactaactacctcctctatgcaattgtgttctcttctgtatccatatgcttcctgattccttttgcaaatccctcatccaatatcgcaagggacgcccggaactgttttcccattgcatgccccaaggtatctttatctttataaaaatagattggcacgtgataaaagtcacacatgtttttgaatttcttcttcgtgttatcagacgcatcatcggcaacgatcaccagggctgccctgccggattttacttccttttccgtactgaactccccgcttaccgtccttccggcctttgtggccaggccaatgagcgacagtatcttattctgattcaagtatatccatctccttttccagcgcatcatacacttcttccggaatggactgcttgaatgaacgttccaggcctttgctcttcctggctttttccaggcattctttggccggacagatgtatgctccacgcccgttcttcctgccggtggaatccagaagaaattctccctcggcagtcctgatgacacgaatcatctctttcttactcttcatttcctgacagcccacgcacttgcgcatgggcacctttttatttccgctcaaacaatcacctattcctctgtatcatctacttcttcaaattctatctcatcttccggatacgcgtcttcctcatatccttcctcgtaatcttcctcataaggctcttcgtacatctcttcttcatagacgccttcgcttaattccatatagttttccggaagttcgcctgactcgatggcctgcgtctcgctcttgatgtcgatcttatatcccgtaagcctcgcagcaagcctcgcgttctgcccttccttgccgatcgccagcgacagctggtaatccgggacgatgacgctggccgccttctcatccggatcggccatgacggaaataacctttgccgggcttaacgcattctcgatcaagatagccggattgtcgctccagttgataatgtcgatcttctcgccccgcagttcattgacgatggcattgaccctggccccgttcatgccgacgcatgcgcccaccggatctacgtccggatcgttggaccatacggcaatcttcgtcctgcttcctgcctctcgcgcaatactcttgatctccacgattccttccttaacctcggtcacctcggattcaaacagacgctttaccaattccggatgcgtgcgtgaaaccagaatctttggccccttggtcgtgttctttacttccactacgtataatttgatacgttcggtaggcttgaatacctcgcccttcacctgctcgttttctgtcagcatcgcgtccgccttgccaagattgatgctgatattcttgccaacataacgctgaacaatacctgtgacgatatctttctccttctcgaaatactggtcatacacgacttttctctcttcctcgcggatcttctgcagaatcaggttcttggcattctgcgtggcaatacggccaaatgacttggactcgatggggatctgcacaatatctcccagttcatactggctgtcgatttcttttgcatcctccaggctgatctgctccagcttatcctccacttcttccactaccgtcttctcagcaaagagctgatagtcgcaggtggttctgtccatgattaatttgatattatcagccttgccaaaatgattcttgcaggcattcagcagagaattctcgatggcatccagcaaagtctctttgctgatatccttttcctcttccaaaatattcaacgcttctaataattctgtgttcattactattctcctcctaatttaaaaatcaaacgccagacgaataagcgcgatatcgcttttttcaaatgttttcagtgtcccatcctccatctcgatggtaacagtcgcatcatcgtaatccttaagcagtccggtaaattccttctgcttctctatcatgcggtatgtcctcacatccacttcttctcccaggcttctcttgaaatccttttctttctttaggggccttccaaggcctggggaactgacctccagaatgtaggcctcctcaatgtagtctttctcgtccaggatgtctgacagcctgcggcttaccacctcgcagtcatctacgttgatcccgcccggcttatcaatgtaggcccgaagataccaggtaccgccttcctttacatactctacatccaccagctcgaatccgtgctcctctacaattggcatcagaatcgcttctgtcttctgttcgtaaatttctctttttgacaaataaatttcctccttatcaacaaagaagagtgaactttgcgttcactcttctgccgatttctttatgtaactgttgttcagtataacaccatatcctggcaaaagcaagggattttcatatatttctcttatttcctgccattcttgaacgcgatcatcatctcattggtgaggcttaagtcatcctccttcaccggaatatcctcccgctcaaaccactgggcaagcgcgagttcctcttgatccagcgtgatcttatcctctccgtccagctcgcagaagaatcccaaaagcagcgtatcggaaaaagaccagggctggctcttataataggtaatattcttaacctgaaggccgacctcttccatgacttctctctttaccgtctcctctatggtctctccgatctcgttgaatcctgccaaaagggcgtatttcttatattcccgcccggcatacttggacatcaggattctgttgccatcagtcaccgcgatgatgaccgccggcgatatcttcggatattccatcaaatggcactcgggacagaacatcatccgttctttagcgtcctttaccattgggcttgcgcatcttccacagtatcttctgctggtataccatctgtgcagctgccatccggtgactccggcaaagttcaggtactttggccctccctccctaagagtctgggtatccagcatttcatatcctttgatcgccctgaaatcgatctcctgctcttcttctgagatgcccagcggatttcccagatagaatctcatcccgtcaatggcaaatagataggtataatcttcgtatagtttctgcctgtccatataggcttccatttcgccaaatgtagggaaacgaatctgccgcccttccatcgccgccaggatagtcctgcctctataggcgaggaagatgctgtcttcatccggcggcagcggctggtattcattccggtattcatgtggttcaatatcctgtatcatatctagtggtctccttatgtttttttatctggactttgtgccgttcccgtctctttttgccactttgagacggttaagcgtcacttccttttctccaaagatgatcttggcctccgtgccttcctcaaacaggtacgcgtgctccaattcatcattcttccgcagtttgatccctctgacgccgatggctcctttcttcttctcggacacttcctgtgccgggaagcggaggaaatagccctctttggtctgcaggacgacctgctggttgtcggtaatcacctgcacgctgatcaactcgtcctccggctgaagcttggtggccgcgatggtgcgcttagccacctggaattcatttccttctacttttttaatcatcccctgcttcgtcgcaaaaagcagccttgcgtagcgcatctgttccgcgtcgcagatatagacgatgttttcctgggtgctgtcgtaattgcttacattatcgatgggaagccccttgtccctgaactttccataaggcagatccagcaccttgacttgatgcatcttcccagtatttgtaaagatgcacagtttccctgtgttcatgcaggaaagcacatgcttgttctccgcatccgcggcttctttgttccgctcgtagatattcgtatctaccgtcttggcatagccaaatcggtccatcaggaatacgacttcctgctcctcgatcttattttcctcataaacagcctcttcggcattctcaatggctgtgcgcctctttctggcgaattcttttttaatcttgtccagatccgctatgatgacttccgccatagaatcatagttgttcaggatatcttcatacctggcgatgttcttaagcgtctcttcatgctctttcatcagggcttccaattccaggccgatcaatttatataagcgcatctccaggatcgccgtggcctgtctctctgtaaagcgcagcatggctgccatcttctttgatatgctggacttgaacttgatattctccgtcaccccgttggtcaggcaggctttggcatcttttacggactggcttccccttaagatctcgatgatcaggtcaatcacatcgcaggccttgatcagcccttcctggatctcttttctgtcctgctcctttttcagaagattctggtatttcctggtggccagctcgaactggaagtccacgtggtgctcgataatcttcttaagccccatcgtctccggccgcccgtttgcaaccgccagcatattaacgccaaaggtgtcttccaggcgggtcttcttatagagcatgttggtcagattctccacatccgcgccccgcttcagttcaatgacgatgcggatgccctctttggatgactggttggatatgtccacgatgtcgctggtcttcttgctctccaccagagcgcagacgtcgttgaggaacttgccgatacccgcgccgatcatggtatatggaatctctgtgatgaccaggcggttcttgccgcctttcatctcctcgatctctactttgccgcggatcttgatctttccgctgcctgcttcgtagatattcagcagttcgtccttgttgaccacgattccccctgtcgggaagtctggtcccttgatatatttcattaactgcttcgtgctgatatcgtcattcttcatataggctttgaccgcctcgatcacttcgcccagattatgggtggggatgctggtcgccattccgactgcaatcccttccgccccgttgaccagaagattgggtatcctcaccggaagcacctccggctccttctccgtctcgtcaaagttgggaatgaagtccacgatgtccttgtccagatcggcaagatacgcctcctgggtgatcttggccaggcgcgcctctgtataacgcatggctgcagcgccgtccccttctatggatccgaagtttccgtgcccgtctacaaggatcattccttttttgaattcctgggccatgacgaccagggattcatagatggaactgtctccgtgggggtggtatttacccatggtatcccccacgatacgggcgcatttcctatagggcctgtcataccggatacccagctcgtacatatcgtagagcgtgcgcctctgaaccggcttaagcccgtcccgtacatccggaagggcccttgctacgatgacgctcatggcatagtcgatgtatgacttcttcatcacatcagagtattcggttcttatgatttgtgaatcctgcatcttttcctctccttacctcgctatatatccagttctgcttccgtagcattttcatagataaatgtccttcttgggggaacctcggtccccatcagcatctctgtcacgccggatgccatcctggcgtcctcgatctccaccagtttgagcatcctggtctccggattcaaagtggtctcccagagctgctgggcatccatctctccaagtcccttatatctctggagggtgaacgggccgtcgtgggtcttgcgataccgctccagcgccttgtcgtcatagagatactcttcctctccctttttcggcatagccttatacagaggcggcatggcaatatacacatgcccttcatagatcagttccggcataaatcggtagaacaaggttaatagcagcgtagagatgtgcgcgccgtccacatccgcatcggccatgatgatgatcttgtcatagcgcagcttcgtaatatcgaaatcattgccatatccttcggaaaatccgcacccgaaggcattgatcatcgtcttgatctccgcgttggccagaaccttgtctatgctggccttttctacatttaagatctttccccggatgggcaggatcgcctggtacatccggtctctggccgtcttggccgaacctccggccgagtctccctccacgatgaatatctcgcacttcccggcgtccttgctctcgcagtttgccagtttcccgttactgtcaaaagaatacttctgctttgttagaagattggtcttggccctctcttccgtcttgcggatcttcgccgccttctccgcgcagccgatcaccttcttcagattatccagattccggtcaaagtaacggatgatctcatcattggtcaccttgctgcacgcttttgccgcgtcagggttgtccaatttcgtcttcgtctgtccttcaaatcggggatccggatgcttgatggagatgatcgctgtcataccgtttcggatatccgcgcctgtgaagttcgcatccttctccttcaagatccccagttccctggaatactggttgatgactgtggtaaaggtcgtcttgaatccggtcaggtgggttccgccttccgcgttatagatattgttacagaagcccaggacattttcatggaattcattgacatactggaatgccacttccacctcgataccatcggactcgcctttgaaatatacgggctcgtggacagcttccttcttggaattgaggtcttctatgaatcctaagattccctccggctcatggtatacgatatgctccgtctcgctgccccgcttatcttcgaatatgatcgtaagtgcaggattcagatatgcggtctcatgcatgcggcttttgacttcttcggcccggaacctggtcttctcaaatatggcgtcatctggaagaaagtttacctttgtccctgtcttgcgggtcttgcctatggtagggagtagtccgtcctccagttcgatcaccggctttcctctctcatacctgtcatgatggatatagccgtcacggctgacttccacatccatatacgttgatagcgcattgactacggaagatccgacaccgtgaagccctccgctggtcttataagcagaatcatcgaattttcctccggcatgaagcgtcgtatataccacgcgctctgcggaaactccggtggcgtgaagatctaccggaacgcctcgcccattatccgagatggtcgccgacccatccttttcaagcgtcacccggatctcgctgcagtagcctgcaagatgctcgtccaccgcattgtccacaatctcgtagatcagatggttcaatcctttggtggaaacgcttcctatatacattcccggccttttccgtaccgcttccagtccttccagtatggaaatactgtctgcatcgtatgtatttttcttagccattctcatatatcctttccactgtatattcctacctattctagaacgtggaaaagtgccccattgggcacacttttccatactgccaatatattagcacgaaatattgtattaatcaaacaatatttattttgcaagtacatgatctagtgtatctgccagcacttccatggcattgcgcatttcctccactgtattcgtctgggctccagcctctatcagcagagtctttggctttaaatgcatgttatagcggtaggctctcagatagatatgccgggtaaatcccggatacttgttggctgccgcaatctgcatctgcaaagagaatgccaggttatcctctatgtatggattggccagatagctgatattgccattggccttggtacggctaagcccattaaagaacatgatctgcgccgtaggcctgccgttgatctccgtcaccagatgagtcccttctgccacgccgtcccggtgaaggtcaatgaccacttcgatgctgggattctcggcaagaatattctggatctgcggctccgccagctggtatgccatgcttcggtccagttttccgtccaccaggtcatacactccttcgtggtgcaaagtctcgatcccgtatgtattgtttaacaggtctgagagataggcgcccatccccatgatggtggtgctggtatcgccttctgtcgaatccgcaaacgcctcctgggaatgcgtatggtagatcagcaccttcgggcctcctttagattggtcgatcttcagatctttccccatgagtttctctgcattgagcaggtccccgtctgccatcgtatttccatctatcgtatagaagtttcccaccaggtattcaaaatttttcagattttccatggaggtatcaattggcgttccagatgtctgggcgacttcctcttccttgtcatcgcctcccaatagctgtccgttttcatccaccgcgttttcatcattggcctgctgggccaggatcatcgcgtatgtctcctcatcttccacatccgtatggacggatgccttgccctccacataggttccaagaggcaccagtttcatggcgctttcggtcacccagtctgagaaggatgcctctttgccgccttccagataggcgaacccggtcagatacgtttcttctgatttctccatcaggaaacggttgatcccatcctgcaccttctttaccggatgcagaggtacctgcatgaacgcatacagaaccaggatgcctgcgatgaccgctatcatgatacggctgatccgctgtttttgtcccacattatccactccgctttaagaaaacgctgcccgctgcataaagcgggcagcacatcatatattttgtgtcttaatactatatgacgctattttccttaatatgtgcatgtcctttggaaaacagcagattcaatgcctcggatatggtgaagctgatgcgctttaccgtctcgtcgatgtcctttggcgttacaaacaggccgtttaggtgcggcgagatcagttctttgaccagttcatacttttccgccgcattatagccctgcatgaccacgcccacccctcttaaggtctccgagctttccagagcggctatcagattctccatggtatcattgacgatcgtagccgcatccacgaccgtgggaacgccgattgcaatgaccgggacgcctaccgtctctttggtgatggcattgcggtgattgcctacgcctgatccaggattgatgccggtatccgcaatctggatggttcggttcagccttctggaacttctggctgcaagcgcgtcaatggcaatgatgatgtccggcttcgtctctttgacgatgcccttgatgatctctaccgtctccatgcctgtctgccccatgactccggggacgatagcgctgattaagttgactgcatcttctcccatggcatatttgccatattccttgatgatgtgccgggtaatattcagattatccaccacgtacggcccaagggcgtccggagtcactttccggttgccaagccccaccacaagcacggaatattcttccttgtcgctttttatgaaccgctcgaggaattttgccagctcgtttgatatctcctggtgatagtcttcatccggcaccgccatattcggcgcctccatggtgatgtacgtgccgaccggctttcccatcgtcttagcgccattctccgtctcgatctttacggtggtcaccttgatctccctctcctcgtcgtaatcttcttccagcacgacgccttgtacttctacattgtccgactcgaatcgctctttctgctcaagagccaggtctgttctgatgctatacttctcaatcatcccttacatcctcactttagtcataatttatttgctagtttttgcaatattttgagaaatatgtattgacagaattctttctgtgtcctaaaataaattagtgtgtttcgttagaacgtccgtgtccggctctaacgaactagaatcgagaaaatcgaaatataggatattggaggtggacaaattggctaatatcaaatctgcaaagaaaagaattttagtaaacgaaacaaaagctgctagaaacaaagcaatcaaatctaaggtaaaaacttgcgtaaagaaagttgaaacagctatcgcaaacaaagatgctgaagctgctaaagcagcattaaaagttgctatcgttgaaatcaacaaagcaggaagcaagggtgtttatcacaaaaacacatgctctagaaagatttcccgtttaacaaaagccgttaacggaattgcttaatagatagagagtcgcatgcaaaaaacagccataccgtcaatggctgttttttttatgcgacaggaaatcgcatttcctcatatctgctacagtttggaatatccaaaactgttgacgatcgcctctactctctggcctgccttgcacattgggcagtcgctgggttcataagccctgtaatccggaatgtccttgctggtgaatatggtcttgatctccatgcccgccaccttcgtaacggcgctgaagatagcgctgactccgcacacggttcctccatagtataggatggactctatagccttgctaatcgtcttgcccgtagtgacggaagcggcaaggatcaatacctgctgattttcgatcatgcgctgtttgttatcccggaacatgatctgtcccagagcgttgtactccggcgttataacagagatattattgtcggcgctgagcgacagcctgctggtgtcagccagttcctccgccagaaatgttccgatcacttccgtctcatccaggcacacgatcgtgttcacataagtattgttcagatactcattggccagcactctggctgcttccctggaattgtgatgcctggtcttgacggtagacatatcgatataagtattcagatgcgaattgcttgttgcgaaatgccctttcattaccttgatgcgcgctttcgggttcttattagagcgtaggtcttcaaacccttccattgtcttgtccattggtctttcctccctgtaaaatatgatagtttattgacataaaatgcatgcggcgcctatagttcggaatatccgtaactattgacgatggcatccacctttgctcctgctttgcatagcgggcaggcatggcttgggtatacctggtaatccgggatatccgccgtagtgaaggcagcatggatatccaatcctgcaacttttgatgccgcgctgaatatcgcgcatacgccgttcacattcccgccataataaaggatggtatcaattgcctgaagcatcgtcttcccggtatttaacgagcccgccagaatcagcacgttctgtccacccaccatgcgcttggtattgtcccggaacatcatctgtcccagctggtttgattcgggtgctacaatagagatattcttcccctggtttaccgacaccgggcctggcgcggcgagcagttccgccatgaaagcgcctaccacttccattccgtccaggcatacgatggtatccacttccaccgatgacagaaatggctccgccagcatcctggccgcttccctagcgtggtcgcacctggatttgatggtggaaatatcaatgtaggtattcacatgggaatggctcctcgcaaaatgtccctgcatgatcttgatgcgcacttttggattcctggctgaccgaagatcccgtaaattcacgtccatagtccactctcctttctcttctattgtcatccgttcctgatctgttaccttcattttagcatactgatatcagaaatacagcaatatttcttcatttttcagaatcttctatatcctggcctgcatccattacaaaagccccatactccattggagtacggggccggttcttatatgtaccttttatgcttcctagttgttgatcaacttctcggagtcgctccagctgtaaaggcttctgacttccttgccgactttttctgacggatgctctgtagccagttttctcatagctctgaagtgcgcctgtccgcctgcctgtgacatatccaataggaactcttttgcaaatgagccgtcctggatgtctgcaagtatcttcttcattgccttctttgtctcatctgtgataatctttggtcctgtgatataatcgccatattccgccgtattggagacagaatatctcattccttcaaatccagactcatagatcaggtcaacgatcagcttcatctcgtgaacgcactcgaagtaagcatttctcgggtcatatcctgcttctaccaatgtatcgaaacctgcctgcatcaatgcgcatacgccgccgcaaagtactgcctgctcgccgaaaaggtctgtctctgtctctgtcctgaatgtagtctcaagaacgccagctcttgctccgccgattccaagcgcatatgcaagcgccttatcaagagccttccctgtataatcctgctctaccgcaacaaggcaaggggttccttttccagcctggtattcgcttcttaccgtgtgtcccggagccttaggagcgatcattgtcacatctacatttgccggtggaacgatctgtccgaagtgaatcgcgaaaccatgcgcgaacatcagcatattgccttcttccaggtttggctcgatgtcttttttgtacattgccgcctgcttttcatcgttaatcaggatcatgatgatgtctgcctgctttgccgcctcggctgcggtgtacaccttcagtccctgtgcctctgccttagcccaggacttgcttccttcgtaaaggccgatgataacgttgcatccggattcctttaagttgagcgcatgtgcatgtccctggcttccgtagccgataattgcgattgtcttaccttccagtaatgataagttacaatcttcctgataataaattcttgctgccatattagcattcctcctacttttgattaaattgaatttgtattgttaaataagggcggacaaatcatctgctcccatttaaaatgcgcctctagtcgatgtatgtaacatccttgattccccgggaaagcccggtaattcccgtcctggcaagttccaggatctcgtagccgtccagaagatttaaaaaagcgtccagcttagactggttgccggtaagctctaccatcaaagactccttctccacatctacgatcttagcccggaatatgtccgcgatagagatgatctctgatctctgggccgcattggcacggatcttgaccatgatcagttccctgtagacagactcgctcggcttaagcaccttgatcttgatgatatcttccagtttccttacctgtttttcaatctgggacaagatcaactcatctccgcttgcaacaatggtaatccttgtaaatctcggatctgccgttacgccagccgtgatactgtcaatactgtatccgcgcctgctgaacagtcctgcgatacggcttaggacaccgggattattgtcgacgattaatgaataaactctttgcatattgcacctctttcccatttgcgttttcaaaaacagagtgcgttctgttttttaatcataacaacatcttttggatttgtcaataggatggcagagattttaacgaaattccaatattccttctacatcctccgtgatatagtccgcgccagccgcctccagttcttcgcggcttccgaatccatacagcactcccaggcagtggatatcattttccctcgccccggccacatcatgctcccggtcgccgatcatcagcaccttggatcgctcggatgtctggcagtttgaaagcgcataacggatcacctccgccttcgtgccccggccgccatcaagctccatccctgccacgtagtcaaaataaggcgacagcccgaagtgctctatgatctgcctcgcaaagggctccggctttgacgtggccaccaccagcgtctttccatcttccttcagtttgcttgccaccgcctcgaatccatcgtatacccggttctcaaagattcctctgtctttatagtactcccggtagtagccgatcgcctccaaggtctgttcctcggagaatccatagaatcttgggaaagaatccgtaagcggcggaccgatgaacttgtataatttgcgcctgtccgtctccacgatcccgtatttttccaatgcgtacatcacggaattcgtgattcccagggaagaatccgtgatcgtcccatctaaatcaaagaaaaatgtgtcatatctactttccatcttaactccttccttttgcctgacatgtaatctgaccttgattatagtatgttcccgccgcttctgcaagcagcaattctgcgtccggctgccgcaaaaatagcgggagcctccgtttgccggagggttcccgctatcccatcttcttactgcagttctactttcatctgcgccgtctctaattctccctggatcgtaacgccgtacgtcttgccttcataggtatattccgtcgtatatacgccgtcttccagcaattcttccgtaatgtcgatctcctggccgccaatcgccagtcccaatgacttgctgtcttcgtggtacaccagttttggattctgttcatcctgatcaatagcgatgtacgtcccgtcttccgcccgaagcaccatatgatcttgcgttgacgcctcttcatccagcgtaagattccgaaaccacacgcttaccttgtctttcacttcctctacgatcttgccgtccgtagccgcaaccgacacgatggatacggatagcgtcagtgccagcacggctgccagcgtaacgaatgccttcttcttgtgccatggccttttccccggctctgccatattcacgacctcctgttctgcctggaaggagggtttcagggcactgcacactctcctgtattcttcttctggaaatctatcttccatatattcctgcctcctccaatgatatttttaaatgcttccttgcccgcatcagccgcgtctgtatggtggaaggattcttctttagcaggatggcgatctccgccgcctggtatccctcataataatacaggtagaccggcactctgtatttcctgggcagagccatgactgcctgaagaatctcctgatccctccttgcttcctctgaatcaaagccccaggccgcgccttcttcgggaaggtattcccggcattcctcatgcttcttccagggggagacgaacatccgcctgcattcattcaccgtcacccgtatcagccagttcttcaaatgctccgggctttcaaatgccaccgctgagcggtacagtttgagaaacacgatctgcatgatatcttccgcatcgtgccggttttggcagtcatgcaatgcaatacggtataccatatccttattcgtttcaacagccacaatatattttccttcttccaacagccacaccccgcaagcagtttcttcttttttgaaaagcctttcacctatcataccttgcagaaggagaaaatatctcattttttaaatattattttatgtcatattccgtatcgttgatcataaccttgtcgatcttgtcaatgtccagcgcttttctgaatttgaccatatattctatcttcatctttccgtctcctccctcgctataacttccgctggcgcccccggatggatgtgtcctgtccgtcccggcctcctcatatcccatgttgccattcatgattttgacgctggttccatcctcaagcactgccgtaacggtggggtaataatactcccatcctcctatgctgccggaactgtcatccgcctttctcgactccccggcgaccctgacgctcatcctgcggatctccaccctgtcaaagcctatatgatcagggaattggttcttgtatggaacgaccgcgatggccttatcctttttcatatgcagcttaaaagatatcttcagaatctcgtcgccatgctcatcgagccagtcctgacctggcatggagggcattccatccgcatacaggatcgtacagttgctgcccgcgctgttccactcgaacatgaagtatttcttcccatcgtccgggtattggtcatattcatatgcacctcctcctgagccagtgcctttcttcgaatctccggtaatccggatgacggggaatgtctcgctctccttaagcgccttctggctgtctgcattcaaggcctccactgagacgagaatatacttgatatctccatctgccagcacatcctccacccgcagacagtaatccttattcctggcttcatggtactgctcctgcatcagatccttttccatctgtccgtcgccgctgccaaaatacgttttaaacaggtccggatgcttgatcgccgcgtaccctgccgttcccgcaaacaggcagagaagcccgatcaccaggactgcggcccatttgggaatatagattcctttcttcctcccatggccatttcctttctgaacttctatctcatccagcagttctacaggaatatcgtcaaacaggtctgtaatcttctctttcattgacatatccccctttccctcagatgtatcttaagcttcttccttgcgcgcatcagtttggacttcaccgtattcctcctgagatccatctcgcctgcaatggtctctgtcgattcatagtagaaataatagcggatcatgatctctctttcatctctcttcagcatgtccaatgcatccttcaagatcttcgcccgttcctccttctccaggcccagacagaaatccgtcacttccacctgatccgtctcctggataagaagcgtctgcgtcttatgctcccggagtttattttttgccttgttcctggcaatggcggccaggtatgctctaaggctgcctttatcaagatcgatccgttctgcatttacccacaggctatagaatgtatcattgaccacttcctgcagatcttcccttgccatcgcgctgccgataatgcggaaaacgatggctgatatgtacgcctcatagacagaaaccgcttcttcaagcgcaatttcattccgtccctttaactgttccagtaatcgttgctcgtccattctatcacctgccttctctttattatagtatacacaacatccggcctggcggttgcatagatacaaaaaaatcgaaaactatagcgtggtaccttttgataccacgccgtttcattgccaagtttttctgttcttacgctatctctttaatctctttcttcgtatcatgctatacgcaactgccgccagccccgcatatgccatcatggctatgaccgacgcctctattccgaaatcccctccagtgagcaggggattctttaactccagcacataactgaagatggacgatgcgtccgcctccgggccgatactcaagatctggctgaccataaacaggttccagacgccgtgtaccagcgctccgctccagatgctgccgctttcataagcgatcagtgcaaacaggattccgactgccgtaccggccagaagcagctgcacagctgacacgaggcttaaacttgctcccagcatatggactgccccgaataagaccgacgaggccaggaccgctgcctttcggttccatctgctctccaggcttttgaggatggttcctctgaatacggcctcctccacaaccgccgccgcgatcccataataggccgcgccgcttaagatcaagacaacgtccgcctgcctagctgtaaccgcttcaaagtgtccgggcagcagcaggcagatgccgcatacagccagcggaagcagaactgccgccacgccccatgccggtcggatcctgactggcgaaagccccagggaggaaggacgcatcttaagccccttcctcccaagcacgcggattccccacaaagcaagggctgcatagagcagggctgccacgatatttcccgccggaaccggcagccctgcagcacaggctgcacttgcgatcagcacagagacagtctgcgctgcgaccagaatcaggatggatatcaggatgcaaacccagatatttttcttatgcatatcctagccctccctactttcaacatttcgcttaaatccgacataagtcgtcaggaaatacagaatatagattcccataaacaacgccagggagatggcaaaatactggaacaccgaggtgcttacgcctgtatagaaaatgaagatattactgataaatactgccacgatgccgctgatcagcgccgcaaagagcgccgggcataggtaatatccgaacagctgcttcaggatcagcctggatacctctcttctgcttagtccgatcttcttgagcacgctgtaccggaacttatactttgcggaatcgcttaactggtgaacggacagcaccgtcaaagccacgcacaggaacaccaggcccacataaaacgcagggaatatgatggaggacagcatatactttacttcgggtatcagattatcccgtaccaggttcacggcattgtatgtgacaatggtatccgtcccatagcagttattccctttcatctcggcatggccaccaaaatcagtattgtcgctcaaatcatccagctgattccccaggccttccggcgcctcccctctgatatctaccgcaagttcgctgtagtagggagtcatgcccgttatcacctgatccgggacgatgatgacatagtcccctccattatggccatcctgggagaaggcttccatatagtagcctgcaaaacgcagtttcccattctccccattgatagatatagcatcctcaaggccttttgcctgatctttcaggcgctgcttgatgtgtatggcaaactggccgtccgatagcgtcacctctttatatcccagcatccttcgaagatggttgtaatccgatagtcccatataggtatcataattgcagtagcattcttccggatttttctcaatctttttcagattcggacttccatcgctgttcagataagagtctccgaatatttgcagatgcgtatacagccacgcgtttgcctgattggtctggcctgcatagatgtggtagataaaggcatcctctatatccgattctttgccgatgatcttcagttcgtcctggaagtcatcattgacgtcagcgctgtatacctgcacgtcaaaaggaaacttatctcccagtacctgattctgccagtcgctgaacatcatggcaatggagcagcctaagaacgcgatggtaaaaagggaggtcagcgtccccatggtaaaacgcatggtcttaaacttggaggaaaactgcctgagcagaaacaggttctggcccttatagattccttttccctttgcccggacatagcagatgatacaggaggaaagcccagtataaaacagatagattaccaggatgagtcccaccagaaacaggattacgctcccggcattattaatcaggccgcagaacaggaagactccaaatgccagcatgaacagaatggaaaccggaagaagccatctttttaacttctcgttggattccttaatctcctcattctgcttattggcattcatcaagtcatggatgttcattttcttaaatcttctgcggcatctgaaaagcgccagcaggtaacagcctgcatagcatgcggcagtcatcagaatgcagtatctgttgaactccagatggaggtcgtatttcatctggatcatgctgtagagaacggacatgatgatctgctgaagcaaagtcccaaggagcattcccagaaagaatgcgcccgttcccatcaacagattttcacgcatgtacagacttgcgatcttctttttcttcatccccagcagcagatagatgccaaattcctggctgcgcttctccagcatgaatcttatcatataattgatcagccaggccacgatcagtacgataaaaaatgtggcaatccccaccatagccgccatcagccctgcaacttcgaacagttcctggacatccctggaaaacaggatgctgttgaacgcgaacataagggccgtcacaaaggtcatggtgagcacatataccagatagtctttgacggaacgtttcacattgcgaaaggcaagtttaccgagcatcggataactcacctcccatcagcgccaggacgtccagaatctcattgaggaactccctcctgcttttagagccgcgcatcagttcgtgaaagatctttccgtcctttaaaaacaggatgcgtctgcagtagctggctgagaatgcatcatgggtcaccatcaggatggtggccttaagcgacgcgttcatattagaaaatgtctccagaagcgtctgggctgatctggaatccagcgccccggtcggctcatctgccagaatcagtcggggattattgaccagcgccctggcgcaggcgcaacgctgcttctgcccgcctgagacctgatagggaaagttatccttaatctccgtaatctcaagcaggcgcagcatctgggcgcatttcttcttgatcgaatcccttccttctttgtgaagcgtcatggcaagcacgatattttcctcaatcgtaagcgtatccagcagattgtagtcctggaatacgaatcccagattgtctttgcggaaatcagacaggccatcctccgacagttccgtgatatcaacgtctccgtaatagatatgtcccgcagtcacgcggtctatggtggacatcatgttaagcagagtcgtctttcccgagccggaggcccccatgactcccacgaattctccctttgccacctggaagctgacccggtctattgccttcgtcacattggagccattcccgtaatatttttccacgtcgcacacgcgtatatagtcattcatattcctgtcactcctttttctttgatactatgactatatcagatacttcccggcgtttgtatcagcctgccttgcagttatcttacagttttgaaagatagctgctgaccggaaattccaggatcatctgcgtgccagcgccttcctgggatctggcagaaatgtcgatgcccagcctgccgcacagttttctgcaaaggtagagtcccatgccggtagagcgttcatgggttcttccattgcttcctgtaaatcccttgtcatagattctccccagttcttcttccttgatcccaattccattgtcgcttaccagcagacggacgccatgcgcatactcctgcgtctcgattcttatgcatgcgtttgaatccctcttatacttggtagcgtttagtaccagctggttcaggatgaaagagatccatttcttatccgtaaaggcccggtgcctgcagtcaatctccgcctgtatcccgttctggatcagataatgcttattcttcgccagcacctcccgggctacctcctgcaagtctgtctcctgtattacatagtccttatacacttcctctgatcttgcatagtacagcgccatatccacgtaattctcgatcttctggttctccaggctgatgcgcctggtaagttcgtcccggtggttctcgcacatcagcgaaatgccggtgatcggcgccttgatttcatgaacccagctttcaatatattcccggtagtccttctgttctgcctcgatctggcggatccgctctatcaccgacttgttggacttgcgtatcatatcctggtaaatgtgatcttccagccggaaagattccggcatcagttctcccaaaagataccgctggtctacatgctccagcacctcctccatctgcttgaaataacgtttccgcctgtagtattccactgccagataagccagcagcacaaggagccagcacaggaagattaccgcgccatacgcggtcggatatccggtggcatagaggaaccctgccaggaggaacatggcgaatccctgaagcaaaaggagcatcacccgatctttgataaaatcaataaacttcatatccgataccccattccccgccgggtctctatgaagccctccactccaatctcctctagcttgcttcggatgcgggtcatgttaacactcagcgtgttgtcatcaataaatacctgattatcccacaggtattctataagctctactctggggacgatctcccccttcttcttaaaaagacaatgcagaatcttcagttcatttttggataattccgtctgcctgccctggaagcttatgtatcctctggcaacatccagttccacgccgttatggctaagcctggccgactcccctattgcttctttccgggcgcgcttcagcacggccgcaatgcgggccagcagaattggaggctggaatggcttggtaatatagtcatccccgcctttgagcattccagtcagctcgtccatcgaatccgtacggctggtcaggaagatgatgggcacctccgataccgcccgcaccttcgtacagatatcaaacccggactcctccggcagattcaagtccagaaggacgatgtccgggtccgccttccatatatcggcggccacgtccccgaagacgtcaagcgccgtcacctgatacagcgcattttccagcaattgcttcagttcctggcgaatggcagcgtcatcctccacaatcaaaatatgcattgatttcacctctttttcaattttacacaggggtttgaacaatttgacacatagcaaaatgcactttgacacgtaacacttttcaaaagtgttacgtgtcaaagtgaaaagtgttacgtgttaagtttacaccagcagtgattttccggtcatttcttttggctgttccatgcccatcagttcgatcaatgtgggggcgatatccgccaggcatccgccttctcttaacttgtaagacggatcagcgttaacgaggatgaacggcaccggattggtggtatgtgctgtaaacggctcgcctgtctcgccgtcaatcagctgttccgcattgccgtgatcggcgcagataaacatctgtccgtccacttccttgatagcatccactgccttgcccacgcattcgtccacggcctcgatggccttgatcgcggcggcttccacgccggtatgacctaccatatccgggttggcgaagttgatgatgatgacatcgtattttcctgaccgaatggcttccgtaagcttgtcgcaaacttcataggcgctcatctccggcttcaagtcataggttgccaccttcggggattttacaaggatcctgtcttctccttcgtttggctcttccacaccgccgttaaagaagaaggttacatgcgcgtatttctctgtctctgcgatacgcgcctgtttcttgccgttctttgccaggaattctccgaaggtattggtaatctcatcttttacgaaggcaaccagtttgttttcaatggtgatatcatattccgtaaagcatacaaaggtggtcttgatccgctcgcctctgtcaaaaccttcaaacttctcatcacagaaggttctggtaatctctctggcacggtccgggcggaagttaaagaaaataatggaatcatcgttctttaccgttgccattggaacgccgtccttttctaccaccgtcggaagcacgaactcatccgtgatatccttatcgtaggaagcctggatccctgccgggccgctatctgcccgctcgccttcgccgaacaccagcgcccggtaggccttttccacgcggtcccagcgattgtcacggtccatggcatagtagcgtcccataacggtcgccacttgtcccacgccgatctcctgcatcttcgctgccagctgctctacatattcctttccggaagccggaggcgtatcacggccgtccaggaagcagtgtacgtatacgttctcgattccctgtctcttagccagttccagcagcccgtaaatgtgctcgttatggctgtggacgccgccatctgacaccagtcccatcaggtggagggaagaatgattctttttaacattctcacatgcggcaagaagcgccggattctcgaagaagtccccgtccttgatcgcctttgtgatcttggtaaggtcctggtatacgatgcggccagcgcccatattcaggtgtcctacctcggagtttcccatctgtccatccggaaggcctaccgccatcccgctggcattgccttttacaaacgggcactctgccatcaatttatccataaccggcgtcttgccctctgctacggcatttccggtagtattctcatttaacccatatccgtctaaaatcataagtactgttggttttttactcatctttaatctccttcaatccaaaatctattgcgcgcctttgcacaagcggccaagccaggcgtctgccagcccgatccattgttggcattcttcctgaacgccggagccatccgccctttctaccagcttgctggcaagactcagtccatgctctccgtctgggaatacatgcagttctactggcacgccggcctttctaagcgccatcgccattaacagggaattttctacaggaacggtatcatctgcggccgtatgccaaagaaagcatggcggcgtttctgctgttacctgcttttccagagacatctcttccagcatcgcctcatattggtctcccagaagattggcaaaacttggcagatgccctgtggcagcatcggatgtgattaccggataactgagcatcagtcctgcgggccgaagcgtctccggcgccactttcagcatctttccgagccacttctgatgccagaatacgcccaggcttgcagccagatggcctcctgcggaggctccgtgcaggatgatcttatccgtatccacatgccagtcttgggcatgctcatggattagcttcatggccattcccagttccagaagcgctgccgggtatctggacggcaccacggaatatcgaagcacgcaggcatgatatccctggttcataaaatggacagccagaggctccccctcccggtaactcaacttttcatatccgccgccggggcagatgatcaccataggccttctggcaatccggatcttgtcggcaggcgtatccagtatataggtttctagtcttgcataaggctgcgaacattctgtccgaaccggaatttccatatatctcataatcagacctctaagcataaggaccgctgcaaagttaccagcggtccttatgttattgcactcttcctgcctatttgtagtttacgatcttgccaaagtcagccttcaaagaagcgcctcctacaaggcctccgtcaatatcagcctgcgcaaataattctgcagcgtttcctgcgtttacagagccgccgtactgaatgcggattgcctctgcagtcgcctcgtcataaatctcagcgatgcatgcgcggattcctgcacatacttcttctgcctgctctgtcgtagcagtcttgcctgttccgatagcccagataggctcataagcgattacagatgcctttgcctggtcagcggtcactcccatgaatccaaccttaacctgctggcggatgaagtccatggtcacgccctgctccctctgctccagcgtctcgccgcagcacatgattggcgtaataccgtgctcgaatgccttgagcatcttcttatttacagtctcattggtctctgcgaaatattctcttctttcagaatgtccaagaactacgtattttactcctgcatcagtaagcatggccggagaaatctctccggtataggctccgctctcttcaaaatacatgttttcagctccaacctggatattggttcccttgcatgcttctactacaggaattatatcaattgcgggtacgcagaataccacatcgacatcctcgcttgctactaatggttttaactcttccaccagggcaaccgcctcgcttggagtcttgttcattttccagtttcctgctacaattttccttcttgccatcttcttttctcctattctattcataatcctcgcactgagctcgaaaatacctcgccaagctttatcatggggatgttccccttactaggctcgcataatacctcgccaagtgcggcgaaccaagtaaacgctaggctcgacaatacctcgccaagctttatcatggggatgttccccttactaggctcgcataatacctcgccaagtgcggcgaaccaagtaaacgctaggctcgacaatacctcgccaagctttttacttgtcgtttgctgctgctacgcctgggagttcttttccttccaggaattccagggaagcgccgccgcctgtggaaatatgtgtcatcttatcgccgtatcccagctggtttaccgctgccgcggaatcgccgccgccgatgatcgtggtcgcatccgtatctgccagggcttttgccactgcctctgttccgtgtgcaaagttaggcatctcaaagcatcccatcggtccgttccatacgacagtctttgcgtcctgaacggcgtcacagaagatcttctctgtctcaggaccgatgtccagtccttcccagccatccggaatctcgccgcgtggcacgacctgggtattagcgtcattcgagaaatcgtctgcaatcacattgtctacaggcagtaacagttttacgcccttttcctctgcctttttaagcatatccagggcatactggcaatagtcttcttccaggagggattttcctacatttccgcccatagccttgctgaacgtataggacattccgcctccgataattaaggtatctactttatcaagcaggttctcgattacggaaatcttgctggatacctttgcgcctccaaggatagctacaaaaggccgctctggattattgactgcatttccaaggaaatcgatctccttctgcatcagatatcctacgactgccgtatctacaaactgcgtaacgcctacatttgagcaatgagccctgtgtgcggtaccgaaagcatcatttacgaatacgtcgcacagagaagcaagatctttgctgaacgcttctccgttcttcgtctcctcgatcctgtatctggtattttcaagaaggataacctctccgtccttcatcgtctctacagctgcctttgcatttggccctactacttctctgtcagcggcaaactttacttcctgtccgagaagttctgaaaggcgcgccgcaaccggcgctaaagacagttccggaaccgactctccctttggctttccaaggtgggagcaaaggattacctttcctccgtccgcaatcagcttcttaatggtcggaagcgctgcgacaagacggttttcatctgtaatcttgccatcgataagaggaacgttaaagtcgcatcttaccagtaccttttttccttttacgttgatatcgtctactgattttttattaagcatatggctgcctcctcagttatatttttaagggcatgtcccttatcatccaagaactggttctaggttataaaaaggatccggtccaataagaccggaccctgcgtgagtcttaatatattgctaagcgctctgtgttaagccagttcagagaagtatttgattgtacgaaccatctggcttgtgtaagaattctcattgtcataccaagatacaacctgaacttctgtagttccgttatctaatggcagtgccagtgtctgagtagcgtcaaataatgagccgtatctcataccgatgatgtcgctggatacgatctcgtctgtgttgtatccgaaggactctgtctctgctgctttcattgctgcattgatctcatcaaccgtaacggttccgtcaacaactgccgtaaggattgtcgtagatcctgttggcgttggaacacgctgagcagcgccgattaattttccatttaactctggaataacaagaccgatcgcttttgcagcacctgtgctgtttggcacgatgttaagcgcagctgcgcgggatcttcttaagtcgccttttctctgaggtccgtcaagagtcatctgatcgcctgtgtaagcgtggatcgtgcacatgattcctgatttgatcttagcaaggtcgttaagagccttagccattggcgctaagcagtttgtcgtgcaggaagctgcggagataacggtatcttccggcttcagtgtttcgtggtttacattatatacgatagttggcaggtcgtttccagctggtgctgagataacgacttttcttgctcctgcttttacatgtgcagatgctttttcttttgatgtgtagaatcctgtacattcaagaacaacgtcaacgccgatctctccccatggaagttcttcagcattagcctttgcgtagattttgatctcttttccgtctacgatgatagaatcttctgtagcctctactttgtcagccaaagcatatttgccctgagaagagtcatattttaacaagtgggcaagcatcttaggagatgtcaagtcgttgatcgctacaacttcatatccttctgctccaaacatctgtctgaacgcaagacgtccaatacgtccgaatccattaatcgctacttttactgccatgattaattcctcctaaagtttgtattaactggttgcacagtcttatatttttgaaatccctcaaccttcgttaaagaatcatcaaccgtattttattgtactaaatttgatacaaaaattcaaggacttttcccatttttatggaagttgcttaaaatgcggcttccgtctggaaaattctgtataatatttaaagccgcagcccttcaggatgtccgatgccttctgaaaatcata
